United States Patent 7,745,391 (HUMAN THROMBOSPONDIN POLYPEPTIDE) - sequence listing, part 107

SEQ ID NO: 320397 - DNA, 2005 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320398 - DNA, 2075 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagccctcccccctcctgcacagagccctgcctgcccggccagtgggtttaccccggggctaatccgacagagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320399 - DNA, 1735 bp, Homo sapiens
  misc_feature (22)..(22): n is a, c, g, or t
  misc_feature (28)..(28): n is a, c, g, or t
gaactacggctagtacgaggcngggttnaatcggccgaggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320400 - DNA, 2201 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagaggtgagtgagccccctgaccccttggcagctggactaggggggaccggccactctcggagaagaggatgaaaagggcctgcagtggtcagcctctcgggaggcagggtgggctctcctaggagaccggcactggctggggcaaggccaggccaaggccacaccattaacccttctcccctccaaccctccctcacagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320401 - DNA, 2557 bp, Homo sapiens
  misc_feature (2)..(2): n is a, c, g, or t
  misc_feature (28)..(28): n is a, c, g, or t
  misc_feature (2204)..(2204): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaaaaaaaaaaaaaaaaaaaaaaaaaaaaaaaatgggggggggctgggccggaaaaagttttaaaaccattgcggtggggcgcgcgggggcgcccaagagggttaacggagaccgggcgcccaataggcgggtcccagagaggaacccgggcacccagagaccaagggcgcgcgggattctcttcacccattataaaanaaagcgcccggggggggcacacccgagaagggtttctcggaaacccaaattccccagagaggggagtcccagagaaggggaccaaaacaccggggaagtcctctatcacacgagagaggagactccccaagaggggaaaaccccgcggacaaatactccaaaatttatagcccccgcgacggaggggggggaacaaacagaaccacccccggggaccagcgccacccacatatcagacgacataaacaacagacaagtacaaacacaaacaacaaccaaaacaaacacaccagctacacacagagatacagcacaaaacaaaccacacacacaccacagcgcgacgagaggat

SEQ ID NO: 320402 - DNA, 1950 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaaccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320403 - DNA, 1243 bp, Homo sapiens
ataacggcttaggtgcgaggccccgggtgtgaatcggcacgaggtggagagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320404 - DNA, 2096 bp, Homo sapiens
  misc_feature (2)..(2): n is a, c, g, or t
  misc_feature (28)..(28): n is a, c, g, or t
  misc_feature (2060)..(2060): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaaaaaaaaaaaaaaacaaaaaaaacaaaaaacaaaaaaaaaaaaaaaaaaaaangggggggggcccccaaaattccccccgggggggccc

SEQ ID NO: 320405 - DNA, 2110 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaaaaaaaagactgacacaagaagccaccaagcagacaaacaaaccacactaatcaacacttatccgtttcgtacgaccaaaactataccaaacgaaagaagggg

SEQ ID NO: 320406 - DNA, 2561 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaggaaacacaacataaaaaaaaaaaaaagaataacaaaacttttgtgggcgccccgcacgggcacccctcaaaaagctttgtgacacccatcctttgggggccggggcccccagatggataagagcggccagcaggggccatcacagcgtgagaatcccaagagagacaagacccgggcaaggaaacaagcgggtggagtggtcttcctcactcctatttaaaatagccgcccggcgggcaagccacgaagctgtttcggaaatatgaccgccaacaaggtagctccggggagcgagcagcggggggccatttctatgcgacatggcgcatcatcaagtcggaatccttccatactattaaacttttccccccccggcgcggctgggggttaacgttaacccttccagttagcacgaagggctttggacacttatgaccccttgttcctgtacctgctacagtacgaaaaatctttttaggtaggaataaaaagccaaggggtttgtgaaaacttatgaatattgaggggtaaagaatttcaactgataaccaag

SEQ ID NO: 320407 - DNA, 2026 bp, Homo sapiens
  misc_feature (2)..(2): n is a, c, g, or t
  misc_feature (28)..(28): n is a, c, g, or t
  misc_feature (1964)..(1964): n is a, c, g, or t
  misc_feature (1974)..(1974): n is a, c, g, or t
  misc_feature (1976)..(1976): n is a, c, g, or t
  misc_feature (1992)..(1992): n is a, c, g, or t
  misc_feature (1995)..(1995): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaacgganatgatcagtntngaaataaccgtgtccnaanaaaaaaaaaaaatgggggcggaaaaataaac

SEQ ID NO: 320408 - DNA, 1249 bp, Homo sapiens
aaagatgtatagctgcgatcctcggtttaatttcagtacgagggcaggcgctttccctttgatattgagccggtagtgtcgcaatgccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320409 - DNA, 1198 bp, Homo sapiens
ggcacgaggacggagactgacccggatggatccggccacctagctatgacccctagtttgcgatactcgcacacgtgaagcaccatccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320410 - DNA, 1596 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctagggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320411 - DNA, 1045 bp, Homo sapiens
cgtttctgtgtttttgttttttttgtttaagaacccccggtttttcctagccgaatcatccccgtttcagactaacttccaactacatcacaatttttcatcagacccaagggagaggcccaggtaaagagacgaggctgtagagagcatagagagaccagtaggaagagggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320412 - DNA, 1977 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgtgctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320413 - DNA, 1579 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattac

SEQ ID NO: 320414 - DNA, 1686 bp, Homo sapiens
  misc_feature (2)..(2): n is a, c, g, or t
  misc_feature (28)..(28): n is a, c, g, or t
  misc_feature (1650)..(1650): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaaaaaaaaaaaaaaaaaacaaaaaaaacaaaaaacaaaaaaaaaaaaaaaaaaaaangggggggggcccccaaaattccccccgggggggccc

SEQ ID NO: 320415 - DNA, 1703 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320416 - DNA, 1746 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttatgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320417 - DNA, 1763 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgaggcgagtgttgggcgataacatcacatgttatcgcccaacacgcccacacacacacacacacacacacacacacacactcttaacagatccttccttatttgagccaaagccacaaatttcattctagagggaaagaagagtttattaccaaaggcctcatgagacacagacagtttcattatgaatggggccagggcacaaaacagaagagaaaggagatgtgacaaacgctaagacacagagaaaaggagacacagagaaaaccatccggaaagacagaggcatgttctggatgattctgaggcggaggaaggcagcgcaaggccagagaacatctgggtgttggggataacatca

SEQ ID NO: 320418 - DNA, 1872 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgtgctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320419 - DNA, 1492 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtggtgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320420 - DNA, 804 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320421 - DNA, 525 bp, Homo sapiens
  misc_feature (11)..(11): n is a, c, g, or t
ctctctccacnctggctctctccacctggctctcacctctaggtccccatactcctatgatctgagtctgagccatgtcttctcctttcccaccccaacctgctctcctcttctactcacttttcccactccaagcccagcccatggagattgacctggatggggcaggccacctggctctcacctctaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320422 - DNA, 845 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacgtgagtggaggccaaaggggtataggtcgggagggccccgggaggactactctggggaaggtgaggtggtgttggtgcccctttcatgccgggctgtgcagctcaggggcagtgaggggcttgagagcacagtctcccatctctcaccagggcattcctgggccccaaagacctcttcccttacgaggaatccaaggagaagtttggcaagcccaacaagaggaaagggttcagcgaggggctgtgggagatcgagaacaaccctactgtcaaggcttccggctatcaggtgagccaccgcctgccccagagaccccctggaaagcagatgtggctgtgggctctggcagcccccggcccacagatgatgcttagtcttcagaaactccagggctttcagggtaggagctaatcagggtggtgggaagggggcttcctgcaagaagggatagggttgggctgtgtggtgtagttgtggttagggacaactgtgagacagcagtctggggggcaagaacaggatggaggcggtaagtggggacaggcctttgttgggcctagtgtgagtataggacacagccttaactctttccacaaaggcttccaggaggaggtgcttgtgagccgggcaggacgaggcgggagggttgccgcccggccgttgcccctgacaggttgctcacttccctctctcacactccgacccctcgctcgctacctctaggccccctccctcccc

SEQ ID NO: 320423 - DNA, 2378 bp, Homo sapiens
gaggaggagtggggaccgggcggggggtggaggaagaggcctcgcgcagaggagggagcaattgaatttcaaacacaaacaactgcacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320424 - DNA, 2155 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacgtgagtggaggccaaaggggtataggtcgggagggccccgggaggactactctggggaaggtgaggtggtgttggtgcccctttcatgccgggctgtgcagctcaggggcagtgaggggcttgagagcacagtctcccatctctcaccagggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320425 - DNA, 1851 bp, Homo sapiens
taagaaactactctttattttagacaacctcataaaattattttcacatcccccccaacttcttgctcttaatcctcatctttttcttccttcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320426 - DNA, 1799 bp, Homo sapiens
  misc_feature (15)..(15): n is a, c, g, or t
  misc_feature (25)..(25): n is a, c, g, or t
  misc_feature (146)..(146): n is a, c, g, or t
gcaaccagaagggtntgccagggcntgcagggactggagtcatcctcccagaactgagagagggccctcccctgtcgtcctccagccgtttaatgccgccgcgaattcgcggccgcgtcgacacggctgcgagaagacgacagaangaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320427 - DNA, 2084 bp, Homo sapiens
  misc_feature (2)..(2): n is a, c, g, or t
  misc_feature (28)..(28): n is a, c, g, or t
  misc_feature (2048)..(2048): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaaaaaaaaaaaaaaaaaaaaaaaaaaaaaaaaaaaaaaaaangggggggggcccccaaaattccccccgggggggccc

SEQ ID NO: 320428 - DNA, 1718 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggagagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320429 - DNA, 2310 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactacaaaaacaaaacaaaacacacaaaaaaaacaaactttttggggcggtctggccctggagaaaggttttcgacaaaaccacttccggtgggggcgcgagggcccccagtagtggtcactggaaacacgtggcgcacatggcggggcccccgagggagctccggggcacgcaaccaagcgctggagtcttccaccaattaaaaggcgcggggggacacacgagggttcggaacccaacccgagaggagtcggaaggccaaggggaccaacccgggggcccaggagccgaaaaaatcccgcgcgcgat

SEQ ID NO: 320430 - DNA, 2052 bp, Homo sapiens
  misc_feature (2)..(2): n is a, c, g, or t
  misc_feature (28)..(28): n is a, c, g, or t
  misc_feature (2012)..(2012): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaaaaanaaaccggcctttgtgggggaaagggtgaggcaggaggtcg

SEQ ID NO: 320431 - DNA, 2117 bp, Homo sapiens
  misc_feature (2)..(2): n is a, c, g, or t
  misc_feature (28)..(28): n is a, c, g, or t
  misc_feature (2081)..(2081): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactacaaaaacaaaacaaaacacacaaaaaaaacaaaaaaaaaaaaaaaaaaaaaaaaaaaaaaaaaaaaaaaaaaaaangggggggggcccccaaaattccccccgggggggccc

SEQ ID NO: 320432 - DNA, 1988 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctcctggtctgttgaaatgtgatgggttggagttaggtcggaacgggaaagttacggttggaataaacgggttcaaaacaaaccacaaag

SEQ ID NO: 320433 - DNA, 1369 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccacgggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320434 - DNA, 2058 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtggtatagcaatcactgagtcaccacgtgtatacactcatataatatcacattgtgttcatatacatcacgagaaatgtgacagacatccatgctaggaggagaagtccttccttctcttccaaacactccatgatggtcgacacccaacccatatcataccattacgacgacacccaagcgacgttataggcgatcttgatacgtttaacacatcaaagagaattgggggggctacacaccagcagtggtcacgggagaccaccgggaccctgaagaccctgaacgggtagactaacacccacatttgggagtggacagatgttagacgacgcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320435 - DNA, 1115 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320436 - DNA, 1776 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaagtcttactcacaccaacacccaacaacaaacaaaaaccccgggccctaagtggcgggggggaaaaaggtctgaagggctaggccagcgtgtcccgaccgtttggcaaggggattggcggccaaagggcgtaatcaaccgtccgaccgccgccacaaggcaagagagaccacacatcaaaaccagcgcacgacccgcaagcgggcgcctcccactcgtcacc

SEQ ID NO: 320437 - DNA, 1611 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaatgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320438 - DNA, 993 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320439 - DNA, 463 bp, Homo sapiens
  misc_feature (2)..(2): n is a, c, g, or t
  misc_feature (28)..(28): n is a, c, g, or t
anggctaggtacgaggctgggtggctgngattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320440 - DNA, 473 bp, Homo sapiens
gtactctacatggaatgcttttgtacaaggttacactgaggtagtagaaagttaaacctaaagagaaaatagaaatctggttaattgatatataaccaaggtctgtttttatttaaacactcattagtattctctcctgcctcggaaagctaagtattttagagtaaagaatgtcatgccttttgatggctaacaagaattcatagtcacaattcgaattcctaattagagtattctcatagaagaggtagaataacaggctaaaaatgccaagaccttaggaatcactgtaaggtgattctagtaatttttataaactaaacctaggcattagtttactgtcttataaagttatcttttcatcataagatagtatataaaactaagagggcttttggtagatctgggcagcctccagcataaggctaattttccctcagaatttctgccaaacggaggatgcaaaagggaag

SEQ ID NO: 320441 - DNA, 243 bp, Homo sapiens
aattctggaggctggcaaatccaaggtcaaaagcctgcatctggtgagggcctccttgtagcatcatcccatggcggaagatggagggggaagacagcgtgagagggcaagaaagcaagacacagccaaacttggttttataacaagctcacttgagataacgaatcctctcccacaatagtgacattaatccatttacgaggacagagccctcatgacctagtcacctctcaaaggtttgac

SEQ ID NO: 320442 - DNA, 390 bp, Homo sapiens
ggatccggttgcagtgagccgagattgagccatcgcactccagcctggacaagagcgaaactccatctcaaaaaaacaaaaagatatggcctgacacacaataaccattcctaaatgattcactttttttgtttgtttgagagaaaaggtttcattatgttgcctaggctggtctcaaactcccaaagtgctgagattacaggtgtaagctgccgcgtccggcccaattcatgattatatttacaggttacataagtgtgtatctgcaggtagtctatgtcaatgacacatttccaccattgtgccataaatggcaaagcagcccgcctctctggctggttccattaaactagaagctccctagggccagagcctcatctgcttgtacag

SEQ ID NO: 320443 - DNA, 940 bp, Homo sapiens
aaaataactaaaagagtgtaattggattgtttgtaacataaaggataaatgcttgagagtatggatgccccactctccgtgatgtaattattcctcattgtatgcttgtatcaaaacatctcggccaggcgtgagccattgtgcccggctgacaaggcttttttcttcacatgagtaatttttttggcttcttctcctccactctagtatttccaccctcagtaaggaatggaaacctgtcccgtctggggtgtgaagtgccctctgctttttcccccacattgtttggggttcccagcacctcagccacattgcatgctgggttttcattgtcattgttgcaaatgaaatggagtagacatgtgaaatgctaacctatctaggacctgatctatgccttcttgggaactgagaatgaagaaacagaaatagatggtggaagaactgcctaaggtgtgaaaagctgaagattctaccactgaagtactgaatatgttgtctagttgtgagactagtgtgtaaaatatatgttttctagatgatttctgagacttgtgatgacaaggaacctgacctaaccccatttttcataaagacaaagaacagcaatgttaaattgccatatgaagagaaacactagtgatgtgcgtggtctccttgcctcttgtttccttccctcttcctcactgacttccccttgcacaggggcttctgttttatcccatttattatttgtggcacctatatcaatgtggggtttgtaataggtgagaaatatttgcttggagaagctcttgtgcaattagcctggcaatgattggccggccatgtttgaatgccagtttctcttctttgctgaagtactttatgataaaagtaagcctagacataaaatctggagagaaccatgcaataaacaagtatttttgaaataaattat

SEQ ID NO: 320444 - DNA, 1082 bp, Homo sapiens
gagcctgctgggacttgaaccagcagtaagattttcacgacacagtgctgtctgcttctccgtaagaagttagaaggtaagaaagccagaaatcccgtggagaggcaaatgtaagggatgtggcaacgaccactctattcctacagggtttcatttgttctagttcatttttctgtagaaatgatgaaaattgaatatactttgcgcaagttgctttaaaaaaaggagtcttgacaagtgtagtttttcaatcctagaagaggaaaacagagtttacttaagggctgtaaaatggttttttcttcttttctatgttttgttcttaacttttagggaaatattaaattaatgctcattcgcttagcaaatgttaatatcgagagaaaaatctaaaatgtaacatagttgttctgtaataaaattttctttattattcttcccttaatttaaaaacaaaataattatgtctatattgcctaggctttataacaatgtttttgatttttgaaaatatgaatcttatttgccaaggtttttaaaaagtagatctattccaattagttataacaaaatttgcaccatcagagacaatatcgttactgttcagggtaagtacacggaactgctgcttggtatctgcatcttctatacctgttatttaagtcctttgaattagagtcaatttgcggcatcatttcttcagtaacacaatgtttctttcctaaacatagaattttacttaaaatccatgaggatttagtcttgaaaatcaacattcagttggggaacagaaacttcgtgctctgcaaccactaggttgtagctcagtatgggtatgtggaacagacaggaagagactctgattagcttgtcatttaatggtcaagaactttatttataaagactatactttcagggatcatttctatagtttgttactagagaaatttctctggacatctagagcacacacaaaaaagaaaaaaggaacttcattcttatgttcaggtcaacggtcttttatatacatacactttcccttggtagagttcagtgattgacaagtattaggattatataac

SEQ ID NO: 320445 - DNA, 337 bp, Homo sapiens
gagcctgctgggacttgaaccagcagtaagattttcacgacacagtgctgtctgcttctccgtaagaagttagaagccctagaaaacaatctcctggtccaaggtgcttgagtgggccgatccagctatatcaagaacctttgagaacaaaattctcaagcatttctgaggggagtcgaataggtgaaaaccttggctggcctgaccttatcatggaacctgacgactttgattctgaagacaaagagatattaagctgggatattaatgatgtgaaactgccacagacagagtctcgctctgctgcccaggctggagtgcagtagcactatctcgg

SEQ ID NO: 320446 - DNA, 532 bp, Homo sapiens
agcctggctgggcaacagagcgagactccatctcaaaaaaaaaaaaaaaagaataaataaaaagcaattaggatatcagatttgtgtttgagtgtgaaacatcttaaacacactcatgtctctactgaatgtagggaaatttggctcttactggttagcaagctttaacatggaaacagaggcagcctttgcttttttcaagtgtttcgtggttgtggtcaagccgctgcatgtgtttgtgcgtcaagtattaatgtgtaaggaatgaggaaaatctgatggagctcttatttgtacagagtaactcatgggtgcctatggcagtggttttgatttgcttaacttattaacacgagcatttcactttcctttccagtctcttccaggtgaaacacaaagtcaggggagtttacctttaacttggtctttccaggaaggcgtccaattgcctggtagttacagtggacatttaatagctaacactcctcagcagaactcactaaatgattgcttttccttctccaagagttat

SEQ ID NO: 320447 - DNA, 2770 bp, Homo sapiens
gagcctgctgggacttgaaccagcagtaagattttcacgacacagtgctgtctgcttctccgtaagaagttagaagccctagaaaacaatctcctggtccaaggtgcttgagtgggccgatccagctatatcaagaacctttgagaacaaaattctcaagcatttctgaggggagtcgaataggtgaaaaccttggctggcctgaccttatcatggaacctgacgactttgattctgaagacaaagagatattaagctgggatattaatgatgtgaaactgccacagaacgtgaaaaaaaccgactggttccaggagtggccagattcctatgccaaacacatctacagctcggaggacaagaatgcgcagcggcacctgagcagctgggccatgcgcaataccaacaaccacaactcccgcatcctcaagaagtcctgcctgggtgtggtggtgtgcggccgcgactgtctcgcagaggaggggcgcaagatctacctgagacctgccatctgtgacaaggcccggcagaagcagcagcggaaacgctgtcccaactgtgacgggcctctgaagctcatcccttgccgaggtcatgggggcttcccggtcaccaacttctggaggcacgacggacgctttatatttttccagtcaaagggagagcatgatcatccaaaaccagaaaccaagttagaagctgaggcaagaagagccatgaagaaagtgaacacagcaccttcctccgtctcattgagcctgaaggggagcacagagaccaggtctcttccaggtgaaacacaaagtcaggggagtttacctttaacttggtctttccaggaaggcgtccaattgcctggtagttacagtggacatttaatagctaacactcctcagcagaactcactaaatgattgcttttccttctccaagagttatggtctgggaggaatcacagatctgactgaccagacttccactgtggaccccatgaagctctatgaaaagcgcaaattgtccagtagcagaacctacagtagtggagacctgcttcctccttctgcctccggagtctactctgatcatggcgatctacaagcgtggagtaaaaatgctgctttggggagaaatcatcttgctgacaactgttattccaattatccttttcctctgaccagctggccttgcagcttctctccttcccaaaactcttcagaacccttttaccagcagcttccattggagccacctgcagccaaaactggctgtcccccattatggccaaatccagcgggtaatctttatgaagagaaagtacatgtggattttaacagctacgtccagtctcctgcataccattcacctcaagaagacccctttctcttcacctacgcctctcatcctcatcagcaatattcactgccaagcaagagcagcaaatgggattttgaggaagaaatgacatacttgggtttggatcactgcaacaatgatatgcttctgaacctgtgtcctttgagatgacccaaatctttcactatgtgcaccccagcccctcaaaaatggggaagggctgaaagaatttccttaggaaataatttttaaaacataaccacagataaatgagaatcatgataagcagtagacaaggcttttttctttttcttttttccttctttttttttttttttttttttttgagacagagtcttgctcttttgcccaggcaggaatgcagtggcgccatctcggctcactgcaacctctgcctcccgggtttgagtgattctcctgcgtcagcctcccgagtagctgggattacaggcacctgccactgcgcctggctaatttttctatttttagtagagacagggttttgccatgttggtcaggctgctctcaaactcctgatctcaagtgatctgcccacctcaccatcccaaagtgctgggattacaggcgtgagccattgtgcccggctgacaaggcttttttcttcacatgagtaatttttttggcttcttctcctccactctagtatttccaccctcagtaaggaatggaaacctgtcccgtctggggtgtgaagtgccctctgctttttcccccacattgtttggggttcccagcacctcagccacattgcatgctgggttttcattgtcattgttgcaaatgaaatggagtagacatgtgaaatgctaacctatctaggacctgatctatgccttcttgggaactgagaatgaagaaacagaaatagatggtggaagaactgcctaaggtgtgaaaagctgaagattctaccactgaagtactgaatatgttgtctagttgtgagactagtgtgtaaaatatatgttttctagatgatttctgagacttgtgatgacaaggaacctgacctaaccccatttttcataaagacaaagaacagcaatgttaaattgccatatgaagagaaacactagtgatgtgcgtggtctccttgcctcttgtttccttccctcttcctcactgacttccccttgcacaggggcttctgttttatcccatttattatttgtggcacctatatcaatgtggggtttgtaataggtgagaaatatttgcttggagaagctcttgtgcaattagcctggcaatgattggccggccatgtttgaatgccagtttctcttctttgctgaagtactttatgataaaagtaagcctagacataaaatctggagagaaccatgcaataaacaagtatttttgaaataaattat

SEQ ID NO: 320448 - DNA, 1122 bp, Homo sapiens
tagcctggaggctgcagtccgcgcggccggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagttctcttagcgtttgtggaatctgccgagccattttgtggaaattgggatccatatctggagacacttcccaaggcctgcctcacctccaccccctgcccaccttgatccatgctcctttgacctcctcgtgtgagaacccctttgccagagtgagacgtgtgcagaatgaactaagccccagagggttttaatggcttgcctgctgtttcccacataaactacctcaggagtcactgtaaaat

SEQ ID NO: 320449 - DNA, 932 bp, Homo sapiens
tagcctggaggctgcagtccgcgcggccggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaacacttttttataatattttctcactgagactcccagggcttttactatctccagaatgtatttttcctttttccgtaagactcaaaagtaatataaggtctacaaaatctactaaaaagtctctgcaaaaagtagatgaagaggactctgatgaagaaagccatcatgatgagatgagtgagcaggaagaggagcttgaggatgatcctactgtagtcaaaaactataaagacctggaaaaagcagttcagtcttttcggtatgatgttgtcctgaagacggggctagatattgggagaaacaaagtggaagatgctttctacaaaggtgaactcaggctgaatgaggaaaaattatggaagaaaagcagaacggtgaaagtgggagatacattggatcttctcattggagaggataaagaagcaggaacagagacagttatgcggattctcttgaaaaaagtgtttgaagagaagactgaaagtgaaaaatacagagtggtgttacggcggtggaaaagtttaaagttgcctaagaagagaatgtctaaataaatggattgctttttagcaatagagctgctttctagtggtaaaggaaggggtcacctgaaaaataggacatttttattaaaataaagcacgatcggccggccccataacatcaaaattacaaatcaaaaaaataaagtttg

SEQ ID NO: 320450 - DNA, 1420 bp, Homo sapiens
ggcgcacaccgccccccgccccccgcccctggccaccaagcgcctccgtggacacgcacttcctgcgagggctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccatagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcactaaaaaaagaaatgattgtcttt

SEQ ID NO: 320451 - DNA, 239 bp, Homo sapiens
  misc_feature (16)..(16): n is a, c, g, or t
  misc_feature (22)..(22): n is a, c, g, or t
  misc_feature (24)..(24): n is a, c, g, or t
gtgtaaggtgatctanaggatntnaccgactagccgacaggcggggaggtgtcatctaccctggccatccccgggatccctcccctgctaatctgaactgtgtcctgaaccccagctattggccaggcccctgttacaaactgcgcagaccacccatagccctgcaaggcctctgcactcaatgcctgtcgggctagtcggggctgtcgggctagtcggggctgtcgggctagtcgggg

SEQ ID NO: 320452 - DNA, 1536 bp, Homo sapiens
ggcgcacaccgccccccgccccccgcccctggccaccaagcgcctccgtggacacgcacttcctgcgagggctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccatagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactctgtatgggggatctcgcgagatcccccatacagagtagctacctaagaacagctaaaagagcacacccgtctatgtagcaaaatagtgggaagattatataggtagaggcgacacacctaccgccacaaaagccagtccaacttactagcagacaaccttagacaagacatttagccaaata

SEQ ID NO: 320453 - DNA, 332 bp, Homo sapiens
accgataccacagttcacagtgagataaagcagtagtagagaggtcttcgtagcacagagagtgagagaaacctccagtctagccagggcttcgagttcacagcccttgaaggactgcgtctgctaacaggttgtcacgttattctttcctgaagcaattggaattctgttcagtcattcaacaaacattgattggctgggttcggtggcttatgcctgtaatcccagtgctttgagaggccgaggagggaggattgcttgaagccaggaatttgagaccagcctgggcagcatagtgataactcatctctagaaaaaatataaataaataa

SEQ ID NO: 320454 - DNA, 764 bp, Homo sapiens
agagtctcgctctgtcgcccagcctggagtgcagtggcgcgatctcggctcactgcaagcttgggaggagtagtttcttaaccgctttcggccattggtcgcagggctaccggcctacagtcccagcaagcgccgggctcgggggtggtgcgcagcctcagagggaggagctgggccgtgtggacctctctgcttccaaacctacgctggcccctcagtctgtgccaccctggctaaggggattgagtccggagagggacttgaggggtaggtcggtgctgggcagtgaggagggtgtgatgctgcgaagtgcatctcgcctttgcccaaatcggacgggtctcagcctcactccatctcccgctgctcagctcggtttccctcaaaagcgtcgcgcctcctccagcccagggagccgcctgctctcctaagctgctgtggaactggcctgaggtcccagacgctgtccattgtgctgctgccctctacaccctccagccagagcgccagttcacccgcttttgggagaactctgccgcctgacctgtccgcggataaggtcacaactttgcaggggggtgacatgggctgtggcttcctggaaatgtcaccctcaccagcaacttttacatagttgtgaattatgaaacatgagggagggtaattattggtttacccaggcgatgttaagagcagaggagaaaaccctaatttccaggcatgtgtcctgagccagggacaggttagccagaccctgctccccc

SEQ ID NO: 320455 - DNA, 2251 bp, Homo sapiens
  misc_feature (479)..(480): n is a, c, g, or t
  misc_feature (494)..(494): n is a, c, g, or t
  misc_feature (549)..(549): n is a, c, g, or t
  misc_feature (566)..(566): n is a, c, g, or t
  misc_feature (571)..(571): n is a, c, g, or t
  misc_feature (993)..(993): n is a, c, g, or t
  misc_feature (1049)..(1049): n is a, c, g, or t
ggaatttgcattttcaccagcgttctcgggtcagagggtttgcctggcaccgcgtactgggaaactcgccaaaagcggtgcaggttggagacgccccaggccgcggtggagttgcgcgcggcttctaaagtggagtggagcaggcctgcaccctccccgccggggctgggacggcgcttccaggcggagaaagacctccgcgggccgcgcgcggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgccctgggcgggcgcgggcggcgggcggcggtgagggcggcnngcggggcggcgccngggggccgggccgagccgggcctgagccgggcccggaccgagctgggagaggggntccggcccgacgtgctnggcgnaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatcngctgagcagcgggatcaatggcagcttcttggtgcgtgagagtgagagcagtcctngccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccggcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagaagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctg

SEQ ID NO: 320456 - DNA, 4427 bp, Homo sapiens
  misc_feature (479)..(480): n is a, c, g, or t
  misc_feature (494)..(494): n is a, c, g, or t
  misc_feature (549)..(549): n is a, c, g, or t
  misc_feature (566)..(566): n is a, c, g, or t
  misc_feature (571)..(571): n is a, c, g, or t
  misc_feature (993)..(993): n is a, c, g, or t
  misc_feature (1049)..(1049): n is a, c, g, or t
  misc_feature (1468)..(1468): n is a, c, g, or t
  misc_feature (1636)..(1636): n is a, c, g, or t
  misc_feature (1908)..(1909): n is a, c, g, or t
  misc_feature (1949)..(1949): n is a, c, g, or t
  misc_feature (2133)..(2133): n is a, c, g, or t
  misc_feature (2730)..(2730): n is a, c, g, or t
  misc_feature (3160)..(3160): n is a, c, g, or t
  misc_feature (3254)..(3254): n is a, c, g, or t
ggaatttgcattttcaccagcgttctcgggtcagagggtttgcctggcaccgcgtactgggaaactcgccaaaagcggtgcaggttggagacgccccaggccgcggtggagttgcgcgcggcttctaaagtggagtggagcaggcctgcaccctccccgccggggctgggacggcgcttccaggcggagaaagacctccgcgggccgcgcgcggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgccctgggcgggcgcgggcggcgggcggcggtgagggcggcnngcggggcggcgccngggggccgggccgagccgggcctgagccgggcccggaccgagctgggagaggggntccggcccgacgtgctnggcgnaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatcngctgagcagcgggatcaatggcagcttcttggtgcgtgagagtgagagcagtcctngccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctngtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctngagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgaccnntcccaggtgtatgagctgctagagaaggactaccgcatgnagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgantaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgnctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaaggcagtgccttagggacccctgctgcagctgagccagtgacccccaccagcaaagcaggctcaggtgcaccanggggcaccagcaagggccccgccgaggagtccagagtgaggaggcacaagcactcctctgagtcgccagggagggacaaggggaaattgtccangctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccctgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccggcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagaagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctg

SEQ ID NO: 320457 - DNA, 4142 bp, Homo sapiens
  misc_feature (479)..(480): n is a, c, g, or t
  misc_feature (494)..(494): n is a, c, g, or t
  misc_feature (549)..(549): n is a, c, g, or t
  misc_feature (566)..(566): n is a, c, g, or t
  misc_feature (571)..(571): n is a, c, g, or t
  misc_feature (993)..(993): n is a, c, g, or t
  misc_feature (1049)..(1049): n is a, c, g, or t
  misc_feature (1468)..(1468): n is a, c, g, or t
  misc_feature (1636)..(1636): n is a, c, g, or t
  misc_feature (1908)..(1909): n is a, c, g, or t
  misc_feature (1949)..(1949): n is a, c, g, or t
  misc_feature (2133)..(2133): n is a, c, g, or t
  misc_feature (2730)..(2730): n is a, c, g, or t
  misc_feature (3160)..(3160): n is a, c, g, or t
  misc_feature (3254)..(3254): n is a, c, g, or t
ggaatttgcattttcaccagcgttctcgggtcagagggtttgcctggcaccgcgtactgggaaactcgccaaaagcggtgcaggttggagacgccccaggccgcggtggagttgcgcgcggcttctaaagtggagtggagcaggcctgcaccctccccgccggggctgggacggcgcttccaggcggagaaagacctccgcgggccgcgcgcggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgccctgggcgggcgcgggcggcgggcggcggtgagggcggcnngcggggcggcgccngggggccgggccgagccgggcctgagccgggcccggaccgagctgggagaggggntccggcccgacgtgctnggcgnaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatcngctgagcagcgggatcaatggcagcttcttggtgcgtgagagtgagagcagtcctngccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctngtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctngagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgaccnntcccaggtgtatgagctgctagagaaggactaccgcatgnagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgantaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgnctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaaggcagtgccttagggacccctgctgcagctgagccagtgacccccaccagcaaagcaggctcaggtgcaccanggggcaccagcaagggccccgccgaggagtccagagtgaggaggcacaagcactcctctgagtcgccagggagggacaaggggaaattgtccangctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccctgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccggcggccactcaggacttcagcaagctcctcagttcggtgaagcattctgggcggcatgcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaacaacactcagtccttccacacttccacccccgtct

SEQ ID NO: 320458 - DNA, 420 bp, Homo sapiens
ccctcgggggagaagggtgtggactccaggagcaactgagccttttctgatcagccatggccaagaacaagcattgggaaacttgttccacagctgggtgagaggggtctgcatttggagggggtgctgggaggaaaggtggccacaaggtggctggccagggttagagctgaacttcaggaagacaagccatggttgtgacacctggggtgggaccaggggtcctgcagcagcatttccaaagggggcgcaggtgacctgagatccaaagatcgagtagggattgggcaggtgaaggggagaaacctggaaggaagagagggcgagtaccctgtggagtagagaaagcctgggctggcggggagcgggagaggacaggtaaggccagccacgtgggctgcaggctgctaagggaagcca

SEQ ID NO: 320459 - DNA, 304 bp, Homo sapiens
atgatgtttcctttcctgcccaatttatctggttaaaacgtctgatacactgttgaatagaagaggcaagggcacatgttcatgtcttgttcctgatattgggagaaagcatcccgtttttcaccactctggccaggacagcctatctgtgcaggaggcattgctggcaccccgtggggactgaggaccaaggaggagctgctcccccacacacgaaacggggtttcaccatgttagccaagatggtctcgatctcctgacctcgcgatccgcccgccttggcctcccagagtgctgggattat

SEQ ID NO: 320460 - DNA, 616 bp, Homo sapiens
atgtatcaatagttcattcctttttattgctgagtcatattccacgatatggacataacacaatttgtttatccattcacctgttgaagcacattaatttcctgtttggggctactacaaataaagctgctatgaacatccgtgtacagttctatgcatgaacataatacttcatttctctgaataaatgtccaagcgtgcatttattggacaatacaataagtgcaggtttaattttaatagaaactgccaactgttttccagactgtgccattttatattaccatgaacagtgcctcagtgatccagtttctctacatccttgtcaacaattggtgttattactattttcattttcaccatacttgatagggtgtagtgatatctcattatagctttgaattatatttccaggaaagctagatgttgcatatcttttcatgtacttagttgtcatctgcataccccttctgtaaaatgtctattcatatatttggttcattttctacttaaactgggtttttttaactgttgaattttaatatattctagatacaagtacttcatcacatatgcagtttgcaattatttgcttacagtgttttcattctcttaa

SEQ ID NO: 320461 - DNA, 578 bp, Homo sapiens
tattcggcacgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320462 - DNA, 845 bp, Homo sapiens
ataattcacaaatttccaaaaggatctagggtggttttaaaaaaatacttatgtggagacatagaattcaagtatgattgctacaaatgtgttttttccccagtctcaagaggaacaccttcttttctgaataccctgtacatctgggaacacactttcctatcctgtctgctactccctctgtggggagctggcagggaagcaaggattctcccctgtgggaaaggcctgagccccacccacagcagtgaatcatctcagtccttgctgcgggttgctgcttaaagtttgccacacacctcctggagcttaccttcacgaattcacccagggtgttattcctccaatagctctcttatataagatcacaaaaagtcttttcttaataaaaaggttgtcttctttggatattatgcatctatgctttaaaaaaaaaagtttttctttttaaatgttcatcttcccacccagccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320463 - DNA, 684 bp, Homo sapiens
gtcgacccacgcgtccggaaatctccaagtcataagacgaagaggacttcctgctcactgtaagagtcagaacaccccacaggcctgactcccttcctgtctggcttgggtggcctttacaagtaccctgtctaagctcgggagggacccgcccgtttctcagctactcccttgagcccatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320464 - DNA, 619 bp, Homo sapiens
tattcggcacgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaagaaaaaaaatattctcacttactaaaatccactaggtttag

SEQ ID NO: 320465 - DNA, 429 bp, Homo sapiens
catagaagaattcagctagtaactgatggagttgaggcttgaacccaagcaacaaaatagttccagggctacgtttttaaccgtccttccactatgctgtactgcctcttcataactgtttgggttttttcccctctttaaggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320466 - DNA, 490 bp, Homo sapiens
tattcggcacgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320467 - DNA, 274 bp, Homo sapiens
tattcggcacgggaggcggggccagcgaggcaagatggagttagtgcaggtcctgaaacgcgggctgcagcagatcaccggccacggcggtctccgaggctatctacgggtttttttcagagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320468 - DNA, 763 bp, Homo sapiens
  misc_feature (605)..(605): n is a, c, g, or t
tattcggcacgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaaaaaaaaaaaaaaaaaaactcgagggngggcccggacccaattcggcctatagtggagcgattacaaattactgggcggcggtttaaacgtcgtgactggaaaaacctgggttaccaacttaatcgcttttgagaatccccttttgcaagtggggaatacgagaagggccgaccgatgcctttcc

SEQ ID NO: 320469 - DNA, 651 bp, Homo sapiens
tattcggcacgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttgatgaagaaactgaggcccaaggaagtatctttaccaaagagacttaatcatgtaattaatggcagaacctggggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320470 - DNA, 575 bp, Homo sapiens
ttatgtaaagtatgcctagggatggaggtcgatgaggactcggcatgatggtcgtgcagagatattacagacggtttctatttcctgagcgtctgcgatgttagtattagttagttttgtagtgagtgtataggaaaagggcatacaggactaggaagcagatcaggaaaatgattatgaggacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320471 - DNA, 552 bp, Homo sapiens
cgcattcggtttcaaaataccggcacaatgggggcacccggtaggcgggtccaagcaaggcaaattggagttagtacaggtccttaaacgtttcgacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaa

SEQ ID NO: 320472 - DNA, 314 bp, Homo sapiens
tcggtaccccttgaatttgaactgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcagttgcaaattcaagggggatcctcatagag

SEQ ID NO: 320473 - DNA, 577 bp, Homo sapiens
tattcggcacgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcagttgcaaattcaagggggatcctcatagag

SEQ ID NO: 320474 - DNA, 603 bp, Homo sapiens
ccaccgtttgattcatttaacatttctgagcagcaaagctgcagtcctaggccccagggcaggagtgagatggtgacaatctgtgggtcaccccagaagcccttggatgtggactgctcctccctcacctcacacgaggcctgtctgtctgcctgccagtctgggagagctaacgtagaaatgggttgttgggtttgtttttaaactaactgtttgccttccagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctg

SEQ ID NO: 320475 - DNA, 789 bp, Homo sapiens
ccaccgtttgattcatttaacatttctgagcagcaaagctgcagtcctaggccccagggcaggagtgagatggtgacaatctgtgggtcaccccagaagcccttggatgtggactgctcctccctcacctcacacgaggcctgtctgtctgcctgccagtctgggagagctaacgtagaaatgggttgttgggtttgtttttaaactaactgtttgccttccagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctgtgtttgtgatcagtttctcagctgactggaaattaacatagtgagtggtcactgaggtcttacagcggcagtgtcaatattccattcctttctgtgacagagcgtgcagtttatgtgaggcttctgcacgtagtaggtgatttctctttagaaagatcattttctcccttcaacttttaacttctg

SEQ ID NO: 320476 - DNA, 1107 bp, Homo sapiens
cccggagccgggaggcgaacttgggacccgctggcctcgctcggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagcaaatatccaccaggagcccttaggaagacagcttcctcttcctccctggaaagactaaattcaacaaacttagtcctgttggattcctatttcattctccatctcgagaatagacgtctgcagggaagcagcttcagggccgttggcttctttgagacctccttcctggtggcttagaatattaacaccacctaagttaaatcgagaaaacatattttcaaagatacaccgaaaaactggggatttgcctaactttgtcagggtagacagatggacgtcagttctctggatgtagcttctttttaaaaatttcccaactgttttgacttgatattttatacttctccaaacattagtgatgctctgtgcgttagccctgcccttgggaaagtgtcagtctgtgaggacaagtaaacaattttctttcttctataaagaaacagtgtaaatccagataacaaacttatcaaaaagtcgcagaattctttgttccgtgaagcttccgggtgttgctccaactgccagagctgctcgggggccttgggtgcaggctcggtgccttctgttcactttacgatgaggaaaccaaggcacgctcagggtctggagcctgcaagtcatagcggagcagagtgtctgactccagagctggtgcatttagccatttcgacctttctcttaaatacaaccttgatattattgttattatcgagacagggtcttgctctgtcacccaggcaggaggacagtgggacgatcatagctcactgcagcctagaggagcaatcctcccgcctcagcctccagagtagctgggactacaggtgtgcaccaccatgcccagctaatttttaagggtttttttgtagagatggagtctcctgggattacaggcatgagccactgcacctggc

SEQ ID NO: 320477 - DNA, 583 bp, Homo sapiens
atttattcttaaaagttaactgtcttttaattttaaaaagtaacgtaaaagtatataagacatgtgaacttaaaaagcataatttatgtacatggtaaacactttaatcatactgagggctacaaagtgcaacagggagtttctctcccacccatggcccccatctcctatagagatgaccgcaggggactgtccttccgtccccctcaggagcagaagtccacgcttggttctgcagtttgctttaagagcaggggaagtccgtgggaagtcctgtggctgtgacctggaggttggttacagcggagaatctgaaagatgtatggttgtgcataaatttttgtttttacagaaaacacaactgcacagtcattctcccgtctttgcctttgccatttgggtctgtcctattgctgtccttttcttcgaccaggagctgctaacttgggttccatattttcctttttagggaaccactcagcacattgcccccactttccaatatggacttgggagggggttctgggaagagcagggaaaaggaaaagagcaatccggatgcaaaatcctccagatttttatt

SEQ ID NO: 320478 - DNA, 609 bp, Homo sapiens
atttattcttaaaagttaactgtcttttaattttaaaaagtaacgtaaaagtatataagacatgtgaacttaaaaagcataatttatgtacatggtaaacactttaatcatactgagggctacaaagtgcaacagggagtttctctcccacccatggcccccatctcctatagagatgaccgcaggggactgtccttccgtccccctcaggagcagaagtccacgcttggttctgcagtttgctttaagagcaggggaagtccgtgggaagtcctgtggctgtgacctggaggttggttacagcggagaatggtattttgcagccgttgtggagagaccacaggcggttgggttcctccagagctgggtgtacacccatctcagcgtcatggctggcggggactgctgtgagtccatcttggaacttgtgcagaaagcggctgtctgctggtgaccgcatggggtgcctggcgaacacctctaacagaggtagggccagtgggagcagaaaccagtggagttgtcaagccggcattatccttcctgctcggcttgtgtccagggttaacgcggaggtcagcttcagtgaggcctggcacttggtcagcg

SEQ ID NO: 320479 - DNA, 2087 bp, Homo sapiens
actttttcacatttttattgtcaattaaaatatccctacaaaatggagtagctttcaatatatagagattaactgcacgagttggacagtgacgtctgccactgaaaccgtgttctcccagctgtggcgtcccacctgaggtgctcacagctgagcccagccggcctccttgttctcagctgggcctctcactgctttgcccctttgctgctgctctgcacggctgccaggaagctttgcagagcagccatctgaccgcggctctgtttcttgaccacctgcattgaatggtgaagtgggcgtgggggcggttctgtagccagtctggtttgtgctctgttgagagggagaggagagcagaatttttaaaggagtatatgtaccagttttggtggagatggacgaagttctgggtctctttaatatttgatttaagaagagaactggtgagagtggaaagtgtggcaggaacgcgtgggccccgcaggcccctggtccagctcacacgctgtccgtcctctcggccttcagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctgaggtcaggagttcaagaccagcctggccaacacggtgaaaccccgtctctactaaaaaatacaaaaattagccaggtgtggtggctcacgcttatgtagtcccagttactcgggaggctgaggcacgagaatcacttgaacctgggaggcggaggttgcagtgagccgagatcgcgccactgcactccagcctgggcaacagagtgagactctgtctc

SEQ ID NO: 320480 - DNA, 1363 bp, Homo sapiens
cccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctg

SEQ ID NO: 320481 - DNA, 1145 bp, Homo sapiens
actttttcacatttttattgtcaattaaaatatccctacaaaatggagtagctttcaatatatagagattaactgcacgagttggacagtgacgtctgccactgaaaccgtgttctcccagctgtggcgtcccacctgaggtgctcacagctgagcccagccggcctccttgttctcagctgggcctctcactgctttgcccctttgctgctgctctgcacggctgccaggaagctttgcagagcagccatctgaccgcggctctgtttcttgaccacctgcattgaatggtgaagtgggcgtgggggcggttctgtagccagtctggtttgtgctctgttgagagggagaggagagcagaatttttaaaggagtatatgtaccagttttggtggagatggacgaagttctgggtctctttaatatttgatttaagaagagaactggtgagagtggaaagtgtggcaggaacgcgtgggccccgcaggcccctggtccagctcacacgctgtccgtcctctcggccttcagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacaggtgaggcggtgggggtcgagctctggtgcagggcccgggggccggaaggaaccggtttccacccagtgtctagcctcagcgtccaggggtgagcggtgcgcctgctgcttttaacttgaagttacgtcttcctccatgaaagaatcaaaactgaagcggtattttgcagccgttgtggagagaccacaggcggttgggttcctccagagctgggtgtacacccatctcagcgtcatggctggcggggactgctgtgagtccatcttggaacttgtgcagaaagcggctgtctgctggtgaccgcatggggtgcctggcgaacacctctaacagaggtagggccagtgggagcagaaaccagtggagttgtcaagccggcattatccttcctgctcggcttgtgtccagggttaacgcggaggtcagcttcagtgaggcctggcacttggtcagcg

SEQ ID NO: 320482 - DNA, 1800 bp, Homo sapiens
cccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcaggtgtgtggggctgcacgtggctcagtcccctcccagggggccccgcctcacctgcagcccgggggctgctctgaccacccggagggtgcacaggacgggcaccagtgggcatagggcacaggatgagcctccagctctgtcctgcatctgccccctgcgcctggcctccgagggctttcctgtctatggcggccctgtcttcttggccctggcactgcggacgctgctcctggtcctaatggctgtactcatctgctgtgtgtggtgccagaagtgtggcttcccgaggcccggcctccccactgggtcctggacctggcgcaggccgtatagactcaggtcctgatgagggcgttgtgggagctgtacctgacaggccttctgaggaagccaagacgccaggagaggctcaggcctgggagtcagtagtttcctaagagggagtggaggctcggggccactctgggtgcagcatggcaaacgtgggcggtatttcagcagctgggccttcatcaaagagaagaccatgttggccgggcgcggtggctcacgcctgcagtcccagcactttgggaggccaaggcgtgtggatcacctgaggtcaggagttcaagaccagcctggccaacacggtgaaaccccgtctctactaaaaaatacaaaaattagccaggtgtggtggctcacgcttatgtagtcccagttactcgggaggctgaggcacgagaatcacttgaacctgggaggcggaggttgcagtgagccgagatcgcgccactgcactccagcctgggcaacagagtgagactctgtctc

SEQ ID NO: 320483 - DNA, 1100 bp, Homo sapiens
tagaggatcccccgtattggtggtgctaccctctatactaatcttcctacacatctccttaattataacattcacagccacagaactaatcatattttatatcttcttcgaaaccacacttatccccaccttggctatcatcacccgatgaggcaaccagccagaacgcctgaacgcaagcaccaccaatactgtattggtggtgctgcctgtattggtggtgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctg

SEQ ID NO: 320484 - DNA, 1549 bp, Homo sapiens
cccggagccgggaggcgaacttgggacccgctggcctcgctcggtgcgcgcctccctccccgcatgcagcccgccgagcgctcgcgggtccccaggatcgacccgtacggattcgagcggcctgaggacttcgacgacgccgcctacgagaagtttttctccagctacctggtcacgctcacccgcagggcgatcaaatggtcccggctgctgcagggcgggggcgtccccaggagccggacagtgaagcgctatgtccggaaaggggtcccgctggagcaccgtgcccgcgtctggatggtgctgagtggggcccaggcgcagatggaccagaatcccggctactaccaccagcttctccagggagagagaaaccccaggctggaggacgccatcaggacagacctgaaccggaccttccccgacaacgtgaagttccggaagaccacggacccctgcttacagaggaccctgtacaatgtgctgctggcatatgggcaccataaccagggagtgggctactgccagggaatgaattttatagcaggatatctgattcttataacaaataatgaagaagaatctttttggctgttagatgctcttgttggaagaatactaccagattactacagcccggccatgctgggcctgaagaccgaccaggaggtcctcggggagctggtgcgggcgaagctgccggctgtgggggccctgatggagcgtctcggtgtgctgtggacgctgctggtgtcccgctggttcatctgcctgtttgtggacatcttgcccgtggagacagtgcttcggatctgggactgtttgtttaacgaaggctcgaagattatcttccgggtggccctgaccttaattaagcagcaccaggagttgattttggaagccaccagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcactacactttagttgtgaattttttaaaagagcagtttaaaatcaggtcattctaccagcttttgatgattagctatgaagtcatactttttaaagaaaacttatttttacctgagagatcaataatatataaaatgtgagtgtgggtttgtatctaataaagtatgccaacacctgtgtttgtgatcagtttctcagctgactggaaattaacatagtgagtggtcactgaggtcttacagcggcagtgtcaatattccattcctttctgtgacagagcgtgcagtttatgtgaggcttctgcacgtagtaggtgatttctctttagaaagatcattttctcccttcaacttttaacttctg

SEQ ID NO: 320485 - DNA, 559 bp, Homo sapiens
gtagggagagagtgaaagcaactcttagacattaatgattgataagtggctgctcagtgtactatttttttcaactctttgtaggcttgcaatcttttaaaaagttgaggaaaacagtccgggtgcagtgcctcacgcctgtaatcccaacattttggcaggctggggtgggaagattgcttgaggccaggagttggagaacggctcaggcaacataagaccccatccctacaacaaataaaaattagctgagcatggtgccatgcacctgtagttgtagctactcaggaggctgagcccaagagttcaaggctgcggtgagctatggtcgtgccaccacactccagcctgggcaataaagtgagaaaccctgtctgtttggaaaaaaaagttgaggaaaacaagtaaacaagaacagcaaaaatctgttagaaaatgtaataatgggccaggtgtggtggctcatgcctgtaatcccagcactttgggaggccgagatgggtggatcacctgaggtcaggagttcaagatcagcttggccaacatggtgaaaccccat

SEQ ID NO: 320486 - DNA, 800 bp, Homo sapiens
ggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcgatatcgcaatgggtatcgcaatgggtatcgcaatgggtatcgcaatgggcattcggcatatagaagttcccgggctagggtttgaattggagctgcagctgatggcctacatataccatagccacaggatc

SEQ ID NO: 320487 - DNA, 1699 bp, Homo sapiens
ggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 320488 - DNA, 1847 bp, Homo sapiens
ggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctattttatggaagttccatatttcatttatcctgtttccttctactgatggctagttaggttattggaagtcttttgctgttgctagttagtcttgtatagacattgtaatgcacatgtgcaaaaatacaagtatgatacaatcttaaag

SEQ ID NO: 320489 - DNA, 667 bp, Homo sapiens
aaataaacactggggtgtttttgaaaaaccctagaaaagtttcccccctggggtctctctaaagggaatattgagaccttgacgaattaccattaaaaagccattccccgtggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 320490 - DNA, 193 bp, Homo sapiens
gggtttttaaaagttcctcaggggattctaatgcactaccaagattgagaactactgctctcagataggattcatttattcacttatttctaccatttaatcagttaatccttctttcagagacatggtagaacacataacttctataattctacgacattcctctcttccttctctctttctttcctctccc

SEQ ID NO: 320491 - DNA, 567 bp, Homo sapiens
gagtgcaatggcacgatctcggctcactgcaacctccttctcccaggttcaagcaattctcctgcctcagcctcctgagtagctgggattacaggtgcatgccgccacacctggctaattttttgtatctttggtggagatggggtttcaccatgttggccaggctggtctcgaactcctgacttcgttatccacccacctcaacctcccaaagtgctgggattacacgcatgagccaccgttcctggccgatattttattttcttaaaaggtcattatcagatgccacaagagtatttctataaactatgacccaagtatagcctaatgttaatagcttaaaataggttttatttaccttttttgccctttaaaagcaaggaattattttttaatggaaagaacatagactttgatgatcagttcacatccttgctttaccccttgaaaaatgtgcaacctggaaagacagcttaacattcctgagtcacatttgtccaaataatacaaacaatggcaacaagacttcagcactaatgtctgatgttttttgtatgattactctgt

SEQ ID NO: 320492 - DNA, 1618 bp, Homo sapiens
ggcggggcctcccaattaaggggatgagggtcaggaagggaacctgggacgctgccaactccatcccccagggattgtgaagggggttccttctggctgtgacagtgctgaacgaggccagagagtgcagctgcctggaggcacaagcctcctcctgatccagggggctccagggagaccaaagcagctgtcaagatgagagaaattgaaaaagaaaatggaaaactctccagcctggctctcagcttctgcatctccatgcaagaccagagacccacatcactccctcactccacccagttccactccaacaatacctgggccctgccaggagtgagaaaacggtcctcttcctgtggataggttgctctctcctcttccagatcagggtattcattggtgctggggaatccacagccctcttcgccaagcaccactggctcagatgcagccccagagctgccccactgggccttcttcagtctgtggagactttaggctgaggagagaagtgcctggaggccaggcttcctgtctctccattcttcacctttctgttctgaaatacttccaagtgctgggattacaggtgtgagccattgtgcccggcctaatctcaacgttttaagaaagtttatgaatttgtgttggactgcttcaaagccatcctaggccgcagttggacaagcttgctttatacctcatagttagagaaggtaatatttagcaagcagagttgttaaagaggaaggccttggctactcaggttatatgacagataggattcatttaggtcaatgcaaggatccaggggagagaacctctgtttacttcatttgtctccccatctcaaaaggactaatatccttgtaaataggagtgtgcagagctgtttgagaacactgctcgtcacttccaaaccccacaggctgaatgatgattgccctcctgatctctaagaaatggagtatgttagggcttaggcctggggccctttatcttctctgtcttcatctcttcttaggtgatctcacccagtaccatgctgtcaataagctgatgactcccaaatctatatatccagccctggttcctctctgggctccactcaacatctcctccccaaccttcctcctctcaatgaaaagcactcaaatgcccagttgctaagaccaaaaacatggtatgtctcactttccctcacctcccacatctaatccatcagcagttcctgtcagttttacatctaaaatactgtgtacctgaatttgaccactcctcatcattcccactcctaccaccatatatttcaggtcatcttccccttcctggactgttgcaatggtctcttccccccgtctctgcttccattcccatcccccaacaatatattctgcacagaactgtgagagatgatcatacgaaataatataaggtttgagatgtacttcaaaagaatttgagaaatagggggctagatgggtatagagatgaaaagattatccatacaatgataattattgaagctgactgaaaagggtacatggggttcatgatactattttctctactgtgtttgtttgaaattttccataataaaaaaagttgaaggaaaaaa

SEQ ID NO: 320493 - DNA, 1074 bp, Homo sapiens
gcttctttaataatctctcccgacctccaagtgctgggattacaggtgtgagccattgtgcccggcctaatctcaacgttttaagaaagtttatgaatttgtgttggactgcttcaaagccatcctaggccgcagttggacaagcttgctttatacctcatagttagagaaggtaatatttagcaagcagagttgttaaagaggaaggccttggctactcaggttatatgacagataggattcatttaggtcaatgcaaggatccaggggagagaacctctgtttacttcatttgtctccccatctcaaaaggactaatatccttgtaaataggagtgtgcagagctgtttgagaacactgctcgtcacttccaaaccccacaggctgaatgatgattgccctcctgatctctaagaaatggagtatgttagggcttaggcctggggccctttatcttctctgtcttcatctcttcttaggtgatctcacccagtaccatgctgtcaataagctgatgactcccaaatctatatatccagccctggttcctctctgggctccactcaacatctcctccccaaccttcctcctctcaatgaaaagcactcaaatgcccagttgctaagaccaaaaacatggtatgtctcactttccctcacctcccacatctaatccatcagcagttcctgtcagttttacatctaaaatactgtgtacctgaatttgaccactcctcatcattcccactcctaccaccatatatttcaggtcatcttccccttcctggactgttgcaatggtctcttccccccgtctctgcttccattcccatcccccaacaatatattctgcacagaactgtgagagatgatcatacgaaataatataaggtttgagatgtacttcaaaagaatttgagaaatagggggctagatgggtatagagatgaaaagattatccatacaatgataattattgaagctgactgaaaagggtacatggggttcatgatactattttctctactgtgtttgtttgaaattttccataataaaaaaagttgaaggaaaaaa

SEQ ID NO: 320494 - DNA, 999 bp, Homo sapiens
ggcggggcctcccaattaaggggatgagggtcaggaagggaacctgggacgctgccaactccatcccccagggattgtgaagggggttccttctggctgtgacagtgctgaacgaggccagagagtgcagctgcctggaggcacaagcctcctcctgatccagggggctccagggagaccaaagcagctgtcaagatgagagaaattgaaaaagaaaatggaaaactctccagcctggctctcagcttctgcatctccatgcaagaccagagacccacatcactccctcactccacccagttccactccaacaatacctgggccctgccaggagtgagaaaacggtcctcttcctgtggataggttgctctctcctcttccagatcagggtattcattggtgctggggaatccacagccctcttcgccaagcaccactggctcagatgcagccccagagctgccccactgggccttcttcagtctgtggagactttaggctgaggagagaagtgcctggaggccaggcttcctgtctctccattcttcacctttctgttctgaaatacttcctgctgggactccagggagttgtcatttgacctttaaccctccactcccaattttctgctcccctcagactgaagcatattgtctaggaacccagaggtgaccccaacctccccactgtcctccagttctatggtttgctttcctgtcttcagtgatctagtttccactccttccagctcatgtggctcatcctccttactgcagttccctccttctttccatattacagaaatctgtttcaatcacaccaaagcccacagcttccttccaagcaacctcccctcaaagctcccctcaaacctcccctcaaagctgtcaaccccttccttagctcaaactgttctgcccccaaatcctgcatgactcccagaacccagatgtctcccttccttactcgttgatgatgctctgacgccttcttaggtcc

SEQ ID NO: 320495 - DNA, 457 bp, Homo sapiens
caactcgggctccacttgcttgctttttaataacagagcagagagaatacaaggccaggagcggggcctggaggaaaacaggacttggggtgctcctgtgagagcggtgggttgagatgggagcccacgggggctgttaatgcctagttcagaggatgggaaaggcagttggagagacgaaggaaggggaaacgccttcatgtcagcaatgagggtgactctagtgacggaactagtcttgggtccctggggcaccactagcctctcggcatcggtggtttctccttactcttcagacgctgccaactccatcccccagggattgtgaagggggttccttctggctgtgacagtgctgaacgaggccagagagtgcagctgcctggaggcacaagcctcctcctgatccagggggctccagggagaccaaagcagctgtcaagatgagagaaattga

SEQ ID NO: 320496 - DNA, 1121 bp, Homo sapiens
ctcaaaaaaaaaaaaaaaaaaaaaaaaaaattatttgttctgtctcaggtcttagggaccccttacctcagctaatgtctctgtcccctaaatgcacatcggtgggcagggcaaacccgtaggtgcccttatccctcccaaggctgcactgcaaagctcctgtgtttccattgcccactttcttctccctctcctttcttttctgattataccaaacaggaatgactcgtgtacttgagtcaaaatcctgatggcattgggaaaagtaaactgaaggaatttttgtacacttataccagctaagatgttctgactgcaacgacagaaaactccagctcaactggcttaaacaagaacagggctctctcacgtgagaagccaagagttagaacaactccaggcccagaatggtcggagctcaagctgcagttctcttagctcagtcttcctcgtactgtgggcttttattggagactagctctcctcatggtggcaagatggctgcaggagttcaggtatctcatccagaagcaagaaaagggcatgtcttgcttgcgtctctaggcgtaagggaactggtccagatgtccccgccccacatcccttcagatcccaattggccagaatatggcacgtgcccatgtttcaaccaatcatgggcaaggacatgggaccagcatgattggcctagacccctggagcctggggctgggcccagcatcccctgaatacacggccatctggaggagaaggtaactgaatttcactggggatctgtgataaaagggagcatgggtgttggggagacacctgttccagttgggtttcctatgaggtccaggacagggcttggtgggcactcggaagccagtgtctgaagtgctcagcatcctcctcttcctcggtggtgggtgtccaccgcccaggccccacccctggccttggacacttcatggaaacactgctgatttgctgtggtgttgggtggctcctatctattccccgtaagtgctggcctctgttgacaccatttctgctacctcatctgagattgttctcatcagctcacagagattcatttcagtgaatgaaccaaatctaagctaaaaagcataaaggag

SEQ ID NO: 320497 - DNA, 446 bp, Homo sapiens
ccctggcaaaggcgaagataacaactcaatttagcctgatattctaatgtgcccttgagaaagtgccctcataattaaggatttgcacaatttctattgggatgggggaggaatcgtgtgccacattatttatcaatatcaaaagagtcactttggaattcagcagtctggagtgcctgcaaacaacagatattctcacccaatgctaatctcgagccacatttagccaaaatgcaagaggtttttattggcacatgtggtgcccttgggtggcattgattaccatcgggtttctaaaggattatttgacagggcttagcacaatcagctcatgaactgccctcctctgctccacctctcccttttgcatcttgttggtacagcttcctgagaaacgctggttgtctgctgccaattcagctcatccagttgcagagggaacaagc

SEQ ID NO: 320498 - DNA, 754 bp, Homo sapiens
  misc_feature (33)..(33): n is a, c, g, or t
gagagagagagagagagagagagagagagaganagagagagagagagagagagagagagagtattggtgcgtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320499 - DNA, 617 bp, Homo sapiens
cggtggatggtgtctcctttactaaataagaaagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320500 - DNA, 987 bp, Homo sapiens
ttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctgtgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgagg

SEQ ID NO: 320501 - DNA, 3450 bp, Homo sapiens
  misc_feature (9)..(9): n is a, c, g, or t
cccgccgcncgacacgctgcgagaagacgacgaaggggggcacgccccgccccagcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320502 - DNA, 3496 bp, Homo sapiens
  misc_feature (3449)..(3449): n is a, c, g, or t
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcaaaaaaaaaaaanaccacaaacaaaaaaaaaaattggtcggcgctgcacctcaaaaagta

SEQ ID NO: 320503 - DNA, 4036 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcatctctctgtgaattgctgctaattattgtctgcaaaagacttcttcagtgctctgctgagaattgaacacccttatccattgattgaaaatggatctgcaagatagaacatcattcatttagctgaggagagaaaggagtgctttactttgggcttctaggacatcctctcaatactatacacacttgcatcaaacttgacatacaggtgctcatttaaagtaaccccaacagaggatgacatatagtttctggttagatagttaaagcccaggggttgtttgtgacttggacaaaactgagacattcttagaaccacagagagtggaaactttgatctctgaaatcttcattattctcatcagatcctcccagcaatatgaatcagctcagtaagtatggctccatcagcagcccctgtctttggcagtttggggaatttcttttgggaaacgtcagtctttttgtcatgccaggaaaagtttaaatcaagttagtcctttagatcttctgatactttttgacttagtttgaatgcagcaggattatttgtgcttctctaaccctgttttacctaaatctcaatacctcaaggaagaa

SEQ ID NO: 320504 - DNA, 3819 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcaaaaaaaaaaaacaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggccgaagcatacccacccccaccggggcgagccccaaaacaccaacccacgagccgcttgacagacaggagaggccacagccaacacagagctacacataacaaatacaaggacccggcccgaccacgcacaacatgacaagtggcgggtacaacaacacgcctcagcgagcttcagggaaagaaccactcggtggggaagagaacgaggcacaccaaaacaaaaaagagcgtgggcagaaaaaaccggagaa

SEQ ID NO: 320505 - DNA, 3472 bp, Homo sapiens
  misc_feature (3424)..(3424): n is a, c, g, or t
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttttgagtcatttatgcctttaatgttacatgtacaaaactgtgtattagtgacgacttatgagggtgctgaagacagaggtgactgggtaccaagaagtctgtacaccaaagaggaactggaactcaaggcnagaatgaggacaagaaaaaaagtcgacgcggccgcgaatttagtagta

SEQ ID NO: 320506 - DNA, 2989 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatggttcctctttggtgtacagacttcttggtacccagtcacctctgtcttcagcaccctcataagtcgtcactaatacacagttttgtacatgtaacattaaaggcataaatgactca

SEQ ID NO: 320507 - DNA, 3305 bp, Homo sapiens
gagcgacccgcgctttaagacggctacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320508 - DNA, 3469 bp, Homo sapiens
agaacctactggaggtaaactgggagagcaagtgttggatctttttaacttgaactaatcttgtttggtggggtacacagtgaggaaaaagaagagctagtgacaaaatctaactcccttctcagtcttaagcaaggtgaaggcaagggagtagaagatatcaagggagtgagtggtggtagccaccaaaggaggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320509 - DNA, 3030 bp, Homo sapiens
acagacgatgcggagaaccctaaaaaaagaagatatacaaaacgaaacagtttattgcttaaatgatgatgatgaaactgaagttttaaaagaggatattattcaagggttctctgctctaggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320510 - DNA, 2636 bp, Homo sapiens
agttcgacggagaactctcactggagaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320511 - DNA, 2281 bp, Homo sapiens
gtgtgaatccggcaccgaggtgctctctgtttgggatttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320512 - DNA, 2655 bp, Homo sapiens
  misc_feature (2639)..(2639): n is a, c, g, or t
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaaggtaaaaataacagatgtgagataaggatagttgcatgcttgtctcctgatactcattgtcctaagcgggnggagacctgtgaccaa

SEQ ID NO: 320513 - DNA, 2892 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacaagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320514 - DNA, 2787 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttagtaagtacttttaatatgcacctggtgttctgtgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgagg

SEQ ID NO: 320515 - DNA, 2863 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttcttttcagaagagcagcgctttaacaacttcctgaaagcccttcaagagaaagtggaaattaaacaattaaatcatttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320516 - DNA, 1497 bp, Homo sapiens
tgtaccggcagtattgacataaactcgactccttagtgttttcacgagacccgcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320517 - DNA, 1505 bp, Homo sapiens
  misc_feature (46)..(46): n is a, c, g, or t
cccgcagctgccacactcccgccctacgggcactctatatcgaggngcagtgggtacttcgcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320518 - DNA, 1358 bp, Homo sapiens
ctctaccccaacttgctaccacagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320519 - DNA, 1571 bp, Homo sapiens
tcagagtaattcgatccgtggacaacaattgtcccatgatgatgtattgacttgtaaaatctcgcgattctactcgtatgaacaggagacattcgaccgactttgttgaaagcgcggtaacctgctcataaatcactagtcgaacagtcggtagagagtactaaattaaacaccagttactcttatgtaagagtcactagactgcattcgatgctttccgggcaggaagccattaatttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320520 - DNA, 1421 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcatacttggctttattttaaagtttgaaactcactagctaggagcatgtttaatatgggtgaactaaggtcgtcttgt

SEQ ID NO: 320521 - DNA, 1201 bp, Homo sapiens
  misc_feature (1052)..(1052): n is a, c, g, or t
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaaaaggaaggattgttccaatgagggaaaaaccaggntaaatttggcttaaaaattggatggaatgaaatgaaaaacccggtaaagtttttttaaaaaggtaggatataattttttctccaagggggttccccggctatttggggaaggtaggatattaaccttccccttttctttttaaaagatg

SEQ ID NO: 320522 - DNA, 1637 bp, Homo sapiens
ttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320523 - DNA, 1189 bp, Homo sapiens
atgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320524 - DNA, 438 bp, Homo sapiens
gccaggactgtataacctgccaatattgccgtggatatctctacgtagaaagcatttgttttagtggagaataatggaaataatcatttttctttcggcttctctgtttaagaggcacagttgaatgctgttgatgctttgattgactccatgagcttggcaaagaaagatgagaagacagacacccttgaagacttgtttccaaccaccaaaatcccaaatcctcgatttcagagattatttcaggtaagagaagaaggatgaacaagtcatatttcttttaaatgaaagagagctaagtgcaaagttgcggtaattggccagtcctaaataaatgtcttttttctctgaaggccccatttgctctatttaatggaagaataacatcttcctctcctacttcagaaggtaaaaatattctgagctcttaaaaagaaa

SEQ ID NO: 320525 - DNA, 697 bp, Homo sapiens
ctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcaggtaagaattgaaaacattgatgggaatttttaattgtacccacgtaaatttctcttttgattagaggtctcccaaatgtttcctttttctgggccactctctaattagtcattgcttaatattctgagttttattaaagaaatagtacacccacccttaatcaccctttttaaagtttgtgttcttggcacatgtttctcatttatttccaggacctgtgtcagtgaagttcaggaatatatagataccatgagaaattaacaagtcaaattgcaaaagatgaaatagtagatttcttcattatgccaagcttgggatacattttttgggcccttttttttttacacatctacaaaaaacattattaattatagaaagtggtctcagatctgagatagtcagtatcttcttatcatcctattaaggttttagaaagtagcatactatggtatagtgattttttttttaaacttttgatcacaaagcagtttgattgagtgaaaaaaaaaa

SEQ ID NO: 320526 - DNA, 3437 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320527 - DNA, 3370 bp, Homo sapiens
tgtatccacagagacgcacttgccagagagattttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320528 - DNA, 3561 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactcaaaaaaaaaaaaaaaaaaaaaattcactgccgtcgtttacacgtctgactgggccctgcgtacccaacttaatcgctgcagacatccccttcggcaggtgcgtaatacaaggcccgccgttcgct

SEQ ID NO: 320529 - DNA, 3089 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaaagggtggggggggtctgagaaaaattggcgttggaaaggagtaaaaaaggaataagggagataacgggttggggcaaaagttaaa

SEQ ID NO: 320530 - DNA, 3330 bp, Homo sapiens
  misc_feature (40)..(40): n is a, c, g, or t
tggggaggacctaaacttacggctaggtacgaaggcctgngtgtccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320531 - DNA, 3367 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320532 - DNA, 2799 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320533 - DNA, 3383 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320534 - DNA, 2951 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagaaaaaaaaaaacaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggcggccgaagcatacccacccccaccggggcgagccccaaaacaccaacccacgagccgcttgacagacaggagaggccacagccaacacagagctacacataacaaatacaaggacccggcccgaccacgcacaacatgacaagtggcgggtacaacaacacgcctcagcgagcttcagggaaagaaccactcggtggggaagagaacgaggcacaccaaaacaaaaaagagcgtgggcagaaaaaaccggagaa

SEQ ID NO: 320535 - DNA, 2693 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagaaaaaaaaaaaaaaaaaaaaattcactgccgtcgtttacacgtctgactgggccctgcgtacccaacttaatcgctgcagacatccccttcggcaggtgcgtaatacaaggcccgccgttcgct

SEQ ID NO: 320536 - DNA, 2498 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacagtggtgcgctcaggggagccaatctcaaaattccacagtactgggcggcctatcccgggagattacctttttag

SEQ ID NO: 320537 - DNA, 2463 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttccaaccaccaaaatcccaaatcctcgatttcagagattatttcagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggttgctcggcgtgtgcatgcacacgccgaaaatccagactacatcatatgagatccgaatggacgaagttgttggagatcctctagaacac

SEQ ID NO: 320538 - DNA, 1854 bp, Homo sapiens
tgtatccacagagacgcacttgccagagagattttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaagccaagaaaaaggatcaagtgactgctcaggaaattttccaagacaaccatgaagatggacctacagctaaaaaattaaagactgagcaagggggagcccacttcagcgtctccagtctggctgaaggcagtgtcacctctgttggaagtgtgaatcctgctgaaaacttccgtgttctagtgaaacagaagaaggccagctttgaggaagcgagtaaccagctcataaatcacatcgaacagtttttggatactaatgaaacaccgtattttatgaagagcatagactgcatccgagccttccgggaagaagccattaagttttcagaagagcagcgctttaacaacttcctgaaagcccttcaagagaaagtggaaattaaacaattaaatcatttctgggaaattgttgtccaggatggaattactctgatcaccaaagaggaagcctctggaagttctgtcacagctgaggaagccaaaaagtttctggcccccaaagacaaaccaagtggagacacagcagctgtatttgaagaaggtggtgatgtggacgatttattggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagtggggtgggaaggggagcacaatttcccttcatactccttttaagcagtgagttatggtggtggtctcatgaagaaaagaccttttggcccaatctctgccatatcagtgaacctttagaaactcaaaaactgagaaatttactacagtagttagaattatatcacttcactgttctctacttgcaagcctcaaagagagaaagtttcgttatattaaaacacttaggtaacttttcggtctttcccatttctacctaagtcagctttcatctttgtggatggtgtctcctttactaaataagaaaataacaaagcccttattctctttttttcttgtcctcattcttgccttgagttccagttcctctttggtgtacagacttcttggtacccagtcacctctgtcttcagcaccctcataagtcgtcactaatacacagttttgtacatgtaacattaaaggcataaatgactca

SEQ ID NO: 320539 - DNA, 1620 bp, Homo sapiens
atgctcagagttccggggcacggtttccccgcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacctcagcagccgattcagcaaaagtcagctggatattataattcatagcttgaagaaatgtgacatctccctgcaattcttcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcagtgagagtctgagaaaactgtgcgtcttcaagaaaattgagaggcattccattcactggccctgccgactgaccattggctccaatttgtctataaggattgcagcctataaatcgattctacaggagagagttaaaaagacttggacagttgtggatgcaaaaaccctaaaaaaagaagatatacaaaaagaaacagtttattgcttaaatgatgatgatgaaactgaagttttaaaagaggatattattcaagggttccgctatggaagtgatatagttcctttctctaaagtggatgaggaacaaatgaaatataaatcggaggggaagtgcttctctgttttgggattttgtaaatcttctcaggttcagagaagattcttcatgggaaatcaagttctaaaggtctttgcagcaagagatgatgaggcagctgcagttgcactttcctccctgattcatgctttggatgacttagacatggtggccatagttcgatatgcttatgacaaaagagctaatcctcaagtcggcgtggcttttcctcatatcaagcataactatgagtgtttagtgtatgtgcagctgcctttcatggaagacttgcggcaatacatgttttcatccttgaaaaacagtaagaaatatgctcccaccgaggcacagttgaatgctgttgatgctttgattgactccatgagcttggcaaagaaagatgagaagacagacacccttgaagacttgtttcttacattcccgggagcctctcccccttcg

SEQ ID NO: 320540 - DNA, 2191 bp, Homo sapiens
agaccggagccgggctccgggcccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgtacagttagtttggttattgaaatcttcctatattgtttaaatgtgtatttgcatagacatagtaaagtgttacagcatttcatgtcttaaaaatatctatgaagatatctaaaatatctatttctatgaagaaacagactttaacaaatataagcaaaattcagttttcttttaaccagtc

SEQ ID NO: 320541 - DNA, 1500 bp, Homo sapiens
atagactcgagttcagaccggaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgta

SEQ ID NO: 320542 - DNA, 511 bp, Homo sapiens
cgacaggctgacgggaacgtttacggtcagcgtgtgtcagcgacgtgcaacccggaagggaagaaggggcgtgtcaggctgcgcaggcggccagtccattggctggaagagaccggagccgggctccgggcccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcaggtaatcaacagcgggggcgctgagacgagagtagttttcgattttggctgccgagttgggggaccggaaggatttgggggtgaggcagagccggactcggtgcatttccgtgtctttagaggagaaggcttttttttgcgtttggcatctgagggactcaagagcggcgcgcatcaccttgggcccaaggctgtgttcgtggctcgttt

SEQ ID NO: 320543 - DNA, 2011 bp, Homo sapiens
agaccggagccgggctccgggcccgaccagaggagggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgta

SEQ ID NO: 320544 - DNA, 1987 bp, Homo sapiens
agaccggagccgggctccgggcccgaccagaggagggcggtgctgcagggctggtccgggaggtgacgaccggcttcggagagtctatcatggcagctcggactggtcatacggccttgagaaggtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatcactgcaccattaataaacaaaaggaaagaatattcagagagaagaattttaggatattcaatgcaggaaatgtatgatgtagtatcgggagtggaggattacaagcattttgttccttggtgcaaaaaatcagatgttatatcaaagagatctggatattgtaaaacaagattagaaattggatttccacctgtgttggagcgatatacatcagtagtaaccttggtgaaacctcatttagtaaaggcatcttgtactgatgggagacttttcaatcatttggagactatttggcgttttagcccaggtcttcctggctacccaagaacttgtaccttggatttttcaatttcttttgaatttcgatcacttctacattcccagcttgccacactcttttttgatgaagttgtgaagcagatggtagctgcctttgaaagaagagcatgtaagctgtatggtccagaaacaaatatacctcgggagttaatgcttcatgaagtccatcacacataaaggcaaaaaagaactggtgccacctgcttctgactttagtttgttcacttttaggaagtattttcatgacatgttttcagaagccagaaagcatttgttaaacgcagctttggttataaacctgcaccattgaaaatttgcacatagaatatagactcacttgtacatagaattatttcttcaagtataattcaaaataatatggacattatcatgttctgcattacaataatgggatgtcatcaccattgctagaatactggcatgattcttctgagcagaagttgaaactgtaaatttaaaccttttaattatcaccttacctgaaagaggttagttaagatattcacacagtatgtattatattaaccatatcacacttaagttattaaattcagactatttgtaacttattgttatagggcctgccgtatggcttaggatatttgagtaatcatatatttaaagtaaaaactttgggctgggcacagtggctcacacctgtaatcccagcacttggggaagctgaggtgggcagatcagttgaggtcaggagttctagaccagcctggtcaacatggcgaaaccccatctctactaaaaatacaaaaattagctgggcgtggtggcacacacctgtaatcccagttacttgggaggctgaggcacaagaatcgcttgaacccgggaggcggaggttgcagttagccaagatcgccctgctgcactccagcctgggcaacagagggagactctgtctccaaaaacaaaaacaaaaactgttagtgaaggttccctgggacttttgatattttaaaaattgttcttatgactagtagataaattcattgccataatgaggctagctcccagataaacagtgtattttcttctttttttttttttttttggtgagtggtccagagctttaagctacttttccagtagtttgccactttctccgaggtagtttggctgctctttcagtaatgctaattgtgtgtcaaattttgtctacaacagtaggcaacagatgaagataagttggttgaatgtctccagcactatgcatccctattttctatttattgtgtacactcactttcagtaatgtgtttcaaactggtattttttaaaaaacaaatcaatgtaaggactgaagttgaagtagcaatgtaataaagttaatttgtttattttttgta

SEQ ID NO: 320545 - DNA, 606 bp, Homo sapiens
tttttctataaatttttaaaatattacttttcaaaaaggaaaagtaaaagggtccattgggctttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaa

SEQ ID NO: 320546 - DNA, 564 bp, Homo sapiens
cttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagatatagaagagtgcacttagtgcactcttctatatctaccaccgatttgaggtgaggattccagcttgctggtactctggaaagatagtgagctgagagaccagcagaattatttttcatgcctcaaacaggtgaatccagtctggaaaaagtgtttggaaaacaaggcttgaagtttgttgcccaagatgttgaaggagagtagaataatacttgtagatatagaagagtgcacta

SEQ ID NO: 320547 - DNA, 3464 bp, Homo sapiens
cttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggatttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaa

SEQ ID NO: 320548 - DNA, 3650 bp, Homo sapiens
cttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggatttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaaaaaaaaaagaaaaacaacaaacaaacaacaacaactctgttcgcgggcggccctgttgcggccctcgagaaagaaagacttttcatacacccctccgcgttgtgggggcgcgcggggggcccccgttgggtttagcggcgacacccggcgcccaagaggcgggctgccccagagggaaacacccgg

SEQ ID NO: 320549 - DNA, 1629 bp, Homo sapiens
  misc_feature (21)..(21): n is a, c, g, or t
  misc_feature (33)..(33): n is a, c, g, or t
tcatcgagctggtaccgggantggagagagaanggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaa

SEQ ID NO: 320550 - DNA, 1694 bp, Homo sapiens
tcgataagggccaagagtcttgtcaaaaagaaaagtgatgttcactggaaagtgtggccaagtttgggatttccttttaaaagtattctaaccaccagaggtttttgatcagctagttccatgttcactgttaacacatgaggacttcttatcactgctggagctcctgcttatctgttttcttgcttgcatactagttggcttatctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaa

SEQ ID NO: 320551 - DNA, 1510 bp, Homo sapiens
ctatcgattaatccataatccagtgctgctcaaacgcctctccttaccggtttagcagtatcttttctattagcaggcctgctacttcgtgcatttactactcatatagtaactctattcatagattccttcactttgctacttcttgtttcccttttttaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaa

SEQ ID NO: 320552 - DNA, 476 bp, Homo sapiens
atgaccaatgagttaccgaattcggagcctcggtacccataagcaggttaatacagacctcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaa

SEQ ID NO: 320553 - DNA, 2747 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtatttcagttctctaagatttttggtctggcattgtggtcttatgatgaaaacatgtatcctcttaatggcggcttctcatatattcatcctgtacattttaaaatttgttaagcaactactgtggctaagcactgcatagcctctatgtatgttattgtggcaggcaaaaggttctgattttgggcacaacctttatataaataacacaaaaattaatg

SEQ ID NO: 320554 - DNA, 404 bp, Homo sapiens
cacagatgggcgtgagcggtgaagaggcttctgagacggagggagaggacaaaccagcaggctgggtccaggtgtcctggctccgaccttaccccctccccggactcacttattcttacggcaagcatgacgggggaaccatgaagatccagcaggaaaacacccagtttctgtatccaaaggcctttcctgttttggtaagccagctgggccaacactccctaaacaaggccaaattccacctttgtgcagctctgcgggggtgctataccaccctataccaccctggtattatttacaatgcagaattttttgagtaattctagctttcaaaaattagtgaagtggtggtatagctgataccaccgtgggaaaacaaataagcaattgacaccaccaaattc

SEQ ID NO: 320555 - DNA, 295 bp, Homo sapiens
tactgtccggcttgcctctactactgccggttcctctactactgccggtgcctcgtagtgctcacgaatacagctcctccccagatgacgccattttccaaagcttggcccgggcatactcttctttcaacccggccatgtctgaccccaattactgccggttcctctactaataggtttggtcctagcctttctattagctcttagtaagattacacatgctagcatccccgtaccagtgagttcaccctctaaatcaccacgatcaaaagggacaagcatcaagcacgcagca

SEQ ID NO: 320556 - DNA, 2454 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320557 - DNA, 2465 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagttccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320558 - DNA, 2451 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcaggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320559 - DNA, 2587 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaatagttcagtataaattgtcgtttttttcttgtgctgactaactataagcatgatcttgttaatgcttatagttagtcag

SEQ ID NO: 320560 - DNA, 1777 bp, Homo sapiens
gatctttatcagcgatagaaatatctgccgagcagagacccggaaaactttcctaagagaaaactttgaacacattcaacacatcgtcattgacgaagctcagaatttccgtactgaagatggggactggtatgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320561 - DNA, 1533 bp, Homo sapiens
ccccccaccgaaagtgtttaatccaggtttgttatttgagcacctgtggcttttttaggtactgttcgcattaataaagtaaagcgcctgaggtcttctcgtcttgctgtgttatccccgccgcttcaacggcaaggtcaatgtcactggttaaaagtaagagacagctgaaccctcgtggagccattcatacgtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320562 - DNA, 1081 bp, Homo sapiens
cagctcgtaccatcagtcgctgactgggaggatacaaaaactccctcattagctacctgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320563 - DNA, 1247 bp, Homo sapiens
  misc_feature (1174)..(1174): n is a, c, g, or t
  misc_feature (1222)..(1222): n is a, c, g, or t
  misc_feature (1229)..(1229): n is a, c, g, or t
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtgatgctnacgatacaggtcttcccagataagccattttccaaacttggccttggncggttcntttaggaaaacggtaccg

SEQ ID NO: 320564 - DNA, 647 bp, Homo sapiens
  misc_feature (5)..(5): n is a, c, g, or t
  misc_feature (76)..(76): n is a, c, g, or t
  misc_feature (81)..(82): n is a, c, g, or t
  misc_feature (84)..(84): n is a, c, g, or t
  misc_feature (87)..(87): n is a, c, g, or t
  misc_feature (89)..(89): n is a, c, g, or t
  misc_feature (92)..(92): n is a, c, g, or t
  misc_feature (94)..(94): n is a, c, g, or t
  misc_feature (96)..(97): n is a, c, g, or t
  misc_feature (99)..(99): n is a, c, g, or t
  misc_feature (102)..(102): n is a, c, g, or t
  misc_feature (104)..(104): n is a, c, g, or t
  misc_feature (107)..(107): n is a, c, g, or t
  misc_feature (109)..(109): n is a, c, g, or t
  misc_feature (112)..(112): n is a, c, g, or t
  misc_feature (114)..(114): n is a, c, g, or t
  misc_feature (116)..(117): n is a, c, g, or t
  misc_feature (123)..(123): n is a, c, g, or t
  misc_feature (129)..(129): n is a, c, g, or t
  misc_feature (139)..(139): n is a, c, g, or t
  misc_feature (183)..(183): n is a, c, g, or t
tatantactatactatactatactatactatactatactatactagtatagtatagtatagtatagtattgtattntattnncnacncnacncnanncnacncnacncnacncnanncggcgncggcgncggcggcgcnagtggtatccttctgcctccctctcttccgccgcgcgcccgtcncgccccgatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320565 - DNA, 1132 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttcctgtgaccccatgggcttggaaagcggcgttttcgcctgttgacctcgggaggtttggggtctaccatgcccgggattattctaccggagtttcaccgcaatgatcttcgtcgtcagggggcccacccttgcgcctaaggggctacgagcagtacgcgagggcctgcaggtttcttgtgcatcactcgcgcgcgtacctacaggaggggctccccccctgcttattgccccacgtttttcttaactttttttgtctgcgcggcctcgtgcaccgcgccccgccccct

SEQ ID NO: 320566 - DNA, 2508 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320567 - DNA, 2445 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320568 - DNA, 2411 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320569 - DNA, 1725 bp, Homo sapiens
tgtgattctagacgatcctctcctatctgaatccagatcctcctatctgattcagcctcctatctgaatccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320570 - DNA, 2065 bp, Homo sapiens
  misc_feature (71)..(71): n is a, c, g, or t
ggggggagggggacgagtgaggcaggggggagggggaggagagaggggggcgagggggcgacgcggagggnacgacgcgggatgggggagggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagttccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaa

SEQ ID NO: 320571 - DNA, 878 bp, Homo sapiens
agcgggtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctgattgcaagctgtatgaagtggggaccctgattccagcacccagctcatgtttggcacacagcgggcttgaatatacattatgaaataatctacattatggaaaaatactgaatatgcagtgtggaaaaaatgaatccatcaatagctgcataacacagtgtattaaaataaaatgttttattcttcatacatt

SEQ ID NO: 320572 - DNA, 1449 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngcggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320573 - DNA, 1534 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngcggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgagactagctttagatggcatctccttggaaagtcttccctgatgtccaggtcctaattgatcacttcattctctgaacttccagtaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320574 - DNA, 441 bp, Homo sapiens
ccatcagtgtaagatgtgacttgcttctccttgtcttctgccacgattgtgaggcctccccaaccacatggaactgtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320575 - DNA, 425 bp, Homo sapiens
atttgtaaaatcgacatcatgatacccactcccagaagttgttcttcccaatggcataggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320576 - DNA, 183 bp, Homo sapiens
gcggccgcctactactactactactgctcgaattcaagcttctaacgatgtacggggccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320577 - DNA, 4145 bp, Homo sapiens
aaggttaagtagcatgcccgaggtcatacactgataaacatgaggccaatgattagatatgtctgacttcacattccacatatttccttacactgttttgcagtgtaaataggtggttaagaagataccaaagtagatctctggttcatcttctgagaagcagaactagaattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaacagtagccagtcatccaggaacatttgagcatcaattcggaggtctgggccatctcttgctttccttgaacacctgatcctggagggacagcatcttctggccaaacaatattatcgaattccactacttaaggaatcactagtctttgaaaatttgtacctggatattctatttaccacttatttttttgtttagttttatttctttttttttttggtagcagctttaatgagacaatttatataccatacaagccactgaccacccatttttaatagagaagttgtttgacccaatagatagatctaatctcagcctaactctattttccccaatcctccttgagtaaaatgaccctttaggatcgcttagaataacttgaggagtattatggcgctgactcatattgttacctaagatccccttatttctaaagtatctgttacttattgctgaatttgtgccaagctcaatcacattcacactaaaatttaacaggagaccctgctgtctttgttgctagcatgagcaaaagtatagaggcctttgcacatggaggatacctagtaaagagcaagtagtctagtttcaagtgtagtatcttgtagggaaatgggagtagctaagcctggaaaggttgaatggggcataatcattaagactaggctaaaaattcgagactttattttttaggcattagggagccccttcccaagtgactatcttccttgaaactttgttttctttcaatgacatcacacgatactggttttattctggactatctatcctactcatgggtccaagggaaacttagtagagatgcgacttgcatggggctgtactcagacatgtggtcctaggtattataatgggattgtccccagattaacaggaagcattgttatcaaaggaagagttcaaactgagatagataagagaagcacaaagtaaaagatagaaaaaacagtgctgagtactttatttctaaggtataaggtgaggccataaacagaaaggtatgcaatgagagtagaggctgcaaaaaaggggaggaaatagaatgtcagaaaggtcaagaagagtggtttaggactgagactgtaagtaatgtaaggattgccaaggaatggtttttatgcagagtcagctgtgtagcacagggagtaagcagtcctgttataaatgggtgaagctgaactccaaaatacaaacttatgtctctttaatttgcccctttcctccctctagtcactaaatgaagatgttcttcaagtttctgtctttgcacttctactctttttgccatctcttcatggggaatgtcacccagatacatgacttcagttcttattttgaatgactcctctatttgcagttataaccctgacatctttcttgaatttttttgccccttaattccaacgaactcctggatgtctatgtagatgtctcataatttaggccaatgctgtacaacttcatgtggcatcatccacatagaatgaataggggttgttcaatatgacagccctgccaagcatctcaaattgaacaggtctataaaggaactcagaatcacttgaatatcacagtccatcagcttcctttcccagtaatttaatttccattaatggtatattaaacatcgtattttcaatcatttttaggtttagtcagctacttaaaaataggctttttcttcacataaataaattgtataccatttaatgtgttttatttcaacagactaatagatcttttaacacttcttagtcctcaaaataaattattaaaaactttgtatttcatgtcatattatataaggaaatagaattttgaagaataattcatgctgttttaaatttttacattgtacattttaatagctaatcaactcttaagtatacatttgatggtaaatagatgctagctaatctggaatcatttgaaatattgattatctgatttatagtttggttgcaaggaaatctactgtaagcaaatcataatagatagcaaatcttagaacatgtagaaaaaaagaaattaaaaaaagcaaatcttagaacatgta

SEQ ID NO: 320578 - DNA, 1439 bp, Homo sapiens
agcgggccggtgcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320579 - DNA, 3397 bp, Homo sapiens
aaggttaagtagcatgcccgaggtcatacactgataaacatgaggccaatgattagatatgtctgacttcacattccacatatttccttacactgttttgcagtgtaaataggtggttaagaagataccaaagtagatctctggttcatcttctgagaagcagaactagaattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320580 - DNA, 1664 bp, Homo sapiens
gattcactgactctttgtcttctagcatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320581 - DNA, 1219 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngcggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320582 - DNA, 3476 bp, Homo sapiens
aaggttaagtagcatgcccgaggtcatacactgataaacatgaggccaatgattagatatgtctgacttcacattccacatatttccttacactgttttgcagtgtaaataggtggttaagaagataccaaagtagatctctggttcatcttctgagaagcagaactagaattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacaggacagcactaattggctgtggcagctgaggctcaggtgcttcgtgagtccacttgtggagtggaggaaggagagaggagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320583 - DNA, 1402 bp, Homo sapiens
agcgggccggtgcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320584 - DNA, 1224 bp, Homo sapiens
agcgggccggtgcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtacctgagctggcctccctgcccgggaagtggcatttgagcatattaaagaactcacaggctgaggggcaccatgtgtagaaagccagacataaaaaggaagaatgattggactgcttctggtttttcgaataaatccccattctaagtt

SEQ ID NO: 320585 - DNA, 944 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngcggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacagcaagcagagtgacaggtaagatgcttctttctttagtcctatatttgttctttgtcaggaagtagagacataaacatgcagaagaggattaaatggatttttgattttgctatttcttggtctctctaactttctctattagttggtctgttagtcttgctggcattgtttgttggcccagtagaagcaaccctctttgctgctagagtttggaaccgattgaggcatagatgcaagtcaggtaggtggagattgaaatggtaactctagaactgaaatgagctagg

SEQ ID NO: 320586 - DNA, 350 bp, Homo sapiens
gtaaaatcgacatcatgatacccactcccagaagttgttcttcccaatggcataggtatgtcaagtacatgctcagtacccgccatgtcataggtgctccgcaggtgttgtccacttggctgcttcactgattcactctcttcctttccacctaggatttctttccacatctgacaaagctcactggctaactcccatttgtgggcatagactgaggtgaactgagggcatgtggccatcacttgctgagaagatccctgcctttcagaggcagggtccccagatccagctctgctttcaggcccctcacctctgtgtctggatgaattggctccagctgttgtgcttcc

SEQ ID NO: 320587 - DNA, 1282 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngcggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320588 - DNA, 798 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngcggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacagatgcaggagaggtgtatgtttggggaagcaacaagcatgggcaactggctaatgaggctgctttccttcctgtgcccagttcttccgctctcgctccctctgtcctcgctcctgcccccggccgtggcctgcgcccccggg

SEQ ID NO: 320589 - DNA, 789 bp, Homo sapiens
aacgcgcgataccataggggtataggtacgaggcctgggtggcgcgtgggcagttcagggctgggcggctgaggtgtcttcaaaaacaaacatatttaaaagattttacttctcatctccaggaagaaccagctaggagtagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacaggtaggtaccagctctttcacgg

SEQ ID NO: 320590 - DNA, 4021 bp, Homo sapiens
gtacggaaaagggagaaacccaataactcgttccgagaccgtacaaattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaacagtagccagtcatccaggaacatttgagcatcaattcggaggtctgggccatctcttgctttccttgaacacctgatcctggagggacagcatcttctggccaaacaatattatcgaattccactacttaaggaatcactagtctttgaaaatttgtacctggatattctatttaccacttatttttttgtttagttttatttctttttttttttggtagcagctttaatgagacaatttatataccatacaagccactgaccacccatttttaatagagaagttgtttgacccaatagatagatctaatctcagcctaactctattttccccaatcctccttgagtaaaatgaccctttaggatcgcttagaataacttgaggagtattatggcgctgactcatattgttacctaagatccccttatttctaaagtatctgttacttattgctgaatttgtgccaagctcaatcacattcacactaaaatttaacaggagaccctgctgtctttgttgctagcatgagcaaaagtatagaggcctttgcacatggaggatacctagtaaagagcaagtagtctagtttcaagtgtagtatcttgtagggaaatgggagtagctaagcctggaaaggttgaatggggcataatcattaagactaggctaaaaattcgagactttattttttaggcattagggagccccttcccaagtgactatcttccttgaaactttgttttctttcaatgacatcacacgatactggttttattctggactatctatcctactcatgggtccaagggaaacttagtagagatgcgacttgcatggggctgtactcagacatgtggtcctaggtattataatgggattgtccccagattaacaggaagcattgttatcaaaggaagagttcaaactgagatagataagagaagcacaaagtaaaagatagaaaaaacagtgctgagtactttatttctaaggtataaggtgaggccataaacagaaaggtatgcaatgagagtagaggctgcaaaaaaggggaggaaatagaatgtcagaaaggtcaagaagagtggtttaggactgagactgtaagtaatgtaaggattgccaaggaatggtttttatgcagagtcagctgtgtagcacagggagtaagcagtcctgttataaatgggtgaagctgaactccaaaatacaaacttatgtctctttaatttgcccctttcctccctctagtcactaaatgaagatgttcttcaagtttctgtctttgcacttctactctttttgccatctcttcatggggaatgtcacccagatacatgacttcagttcttattttgaatgactcctctatttgcagttataaccctgacatctttcttgaatttttttgccccttaattccaacgaactcctggatgtctatgtagatgtctcataatttaggccaatgctgtacaacttcatgtggcatcatccacatagaatgaataggggttgttcaatatgacagccctgccaagcatctcaaattgaacaggtctataaaggaactcagaatcacttgaatatcacagtccatcagcttcctttcccagtaatttaatttccattaatggtatattaaacatcgtattttcaatcatttttaggtttagtcagctacttaaaaataggctttttcttcacataaataaattgtataccatttaatgtgttttatttcaacagactaatagatcttttaacacttcttagtcctcaaaataaattattaaaaactttgtatttcatgtcatattatataaggaaatagaattttgaagaataattcatgctgttttaaatttttacattgtacattttaatagctaatcaactcttaagtatacatttgatggtaaatagatgctagctaatctggaatcatttgaaatattgattatctgatttatagtttggttgcaaggaaatctactgtaagcaaatcataatagatagcaaatcttagaacatgtagaaaaaaagaaattaaaaaaagcaaatcttagaacatgta

SEQ ID NO: 320591 - DNA, 4091 bp, Homo sapiens
aaggttaagtagcatgcccgaggtcatacactgataaacatgaggccaatgattagatatgtctgacttcacattccacatatttccttacactgttttgcagtgtaaataggtggttaagaagataccaaagtagatctctggttcatcttctgagaagcagaactagaattctcctggctagcagttatccatctagtgcatatgtatctagagctggccaggcctttagtttacaaaataaatagaaagccttgtccccactctggaggagcttgctgccttgttagaaggtgagatatgttcgaatagaacatttggggaaaccatttgagacctggtataatgaagtgctaagattgtgggcaaggtggggaggaggtaggccttcctgactagtttaggctacaatagttgggaagactgcaagaagccagcaggcttcagtcatgccctaaaagagcgattggtttagaaaaaaaacaaaagggaactactaacatgtattctattctaggcaggtgtcaggcaaagttgtatcttattttggtctcactagattcttgcaaagcttatctgcatatccaggttttataaaaggttaagaaactgaagctcctagaagtaaatgagcccttagttatcaaatattgtctgcattgtgcaacttcttttttagcccgtagtctttgttttcatactttagttttagagaattactccaaattcatcatgattgaagacaataaggagaacaaagaccattccttagaaaggggaagagcaagtctcattttttccttaaagaatgaagttggaggacttataaaagccctgaaaatctttcaggagaagcatgtgaatctgttacatatcgagtcccgaaaatcaaaaagaagaaactcagaatttgagatttttgttgactgtgacatcaacagagaacaattgaatgatatttttcatctgctgaagtctcataccaatgttctctctgtgaatctaccagataattttactttgaaggaagatggtatggaaactgttccttggtttccaaagaagatttctgacctggaccattgtgccaacagagttctgatgtatggatctgaactagatgcagaccatcctggcttcaaagacaatgtctaccgtaaacgtcgaaagtattttgcggacttggctatgaactataaacatggagaccccattccaaaggttgaattcactgaagaggagattaagacctggggaaccgtattccaagagctcaacaaactctacccaacccatgcttgcagagagtatctcaaaaacttacctttgctttctaaatattgtggatatcgggaggataatatcccacaattggaagatgtctccaactttttaaaagagcgtacaggtttttccatccgtcctgtggctggttacttatcaccaagagatttcttatcaggtttagcctttcgagtttttcactgcactcaatatgtgagacacagttcagatcccttctataccccagagccagatacctgccatgaactcttaggtcatgtcccgcttttggctgaacctagttttgcccaattctcccaagaaattggcttggcttctcttggcgcttcagaggaggctgttcaaaaactggcaacgtgctactttttcactgtggagtttggtctatgtaaacaagatggacagctaagagtctttggtgctggcttactttcttctatcagtgaactcaaacatgcactttctggacatgccaaagtaaagccctttgatcccaagattacctgcaaacaggaatgtcttatcacaacttttcaagatgtctactttgtatctgaaagttttgaagatgcaaaggagaagatgagagaatttaccaaaacaattaagcgtccatttggagtgaagtataatccatatacacggagtattcagatcctgaaagacaccaagagcataaccagtgccatgaatgagctgcagcatgatctcgatgttgtcagtgatgcccttgctaaggtcagcaggaagccgagtatctaacagtagccagtcatccaggaacatttgagcatcaattcggaggtctgggccatctcttgctttccttgaacacctgatcctggagggacagcatcttctggccaaacaatattatcgaattccactacttaaggaatcactagtctttgaaaatttgtacctggatattctatttaccacttatttttttgtttagttttatttctttttttttttggtagcagctttaatgagacaatttatataccatacaagccactgaccacccatttttaatagagaagttgtttgacccaatagatagatctaatctcagcctaactctattttccccaatcctccttgagtaaaatgaccctttaggatcgcttagaataacttgaggagtattatggcgctgactcatattgttacctaagatccccttatttctaaagtatctgttacttattgctgaatttgtgccaagctcaatcacattcacactaaaatttaacaggagaccctgctgtctttgttgctagcatgagcaaaagtatagaggcctttgcacatggaggatacctagtaaagagcaagtagtctagtttcaagtgtagtatcttgtagggaaatgggagtagctaagcctggaaaggttgaatggggcataatcattaagactaggctaaaaattcgagactttattttttaggcattagggagccccttcccaagtgactatcttccttgaaactttgttttctttcaatgacatcacacgatactggttttattctggactatctatcctactcatgggtccaagggaaacttagtagagatgcgacttgcatggggctgtactcagacatgtggtcctaggtattataatgggattgtccccagattaacaggaagcattgttatcaaaggaagagttcaaactgagatagataagagaagcacaaagtaaaagatagaaaggtatgcaatgagagtagaggctgcaaaaaaggggaggaaatagaatgtcagaaaggtcaagaagagtggtttaggactgagactgtaagtaatgtaaggattgccaaggaatggtttttatgcagagtcagctgtgtagcacagggagtaagcagtcctgttataaatgggtgaagctgaactccaaaatacaaacttatgtctctttaatttgcccctttcctccctctagtcactaaatgaagatgttcttcaagtttctgtctttgcacttctactctttttgccatctcttcatggggaatgtcacccagatacatgacttcagttcttattttgaatgactcctctatttgcagttataaccctgacatctttcttgaatttttttgccccttaattccaacgaactcctggatgtctatgtagatgtctcataatttaggccaatgctgtacaacttcatgtggcatcatccacatagaatgaataggggttgttcaatatgacagccctgccaagcatctcaaattgaacaggtctataaaggaactcagaatcacttgaatatcacagtccatcagcttcctttcccagtaatttaatttccattaatggtatattaaacatcgtattttcaatcatttttaggtttagtcagctacttaaaaataggctttttcttcacataaataaattgtataccatttaatgtgttttatttcaacagactaatagatcttttaacacttcttagtcctcaaaataaattattaaaaactttgtatttcatgtcatattatataaggaaatagaattttgaagaataattcatgctgttttaaatttttacattgtacattttaatagctaatcaactcttaagtatacatttgatggtaaatagatgctagctaatctggaatcatttgaaatattgattatctgatttatagtttggttgcaaggaaatctactgtaagcaaatcataatagatagcaaatcttagaacatgtagaaaaaaagaaattaaaaaaagcaaatcttagaacatgta

SEQ ID NO: 320592 - DNA, 1508 bp, Homo sapiens
agcgggccggtgcaggccctgaggggcgccgagatgtgggagctgctggccgcggcgtgggcagttcaggggctgggcggctgaggtgtcttcaaaaacaaacatatttaaaagattttacttctcatctccaggaagaaccagctaggagtagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320593 - DNA, 1552 bp, Homo sapiens
agcgggccggtgcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagaagtatagtttccagaagaaggaaggccaaagctcagccctttctgctgttcagcctgcatctgggatgttgtgttttgttgtggatttggtgcttaggccctgggcataaagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320594 - DNA, 1297 bp, Homo sapiens
gcagttctggtatgccatccaggaagaaccagctaggaggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcatctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 320595 - DNA, 2240 bp, Homo sapiens
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaagagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 320596 - DNA, 2262 bp, Homo sapiens
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaatctgtgttttatcattttttaggagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 320597 - DNA, 1162 bp, Homo sapiens
  misc_feature (1118)..(1118): n is a, c, g, or t
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataagctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcnagacataacttacctatttttagcaccaagaattatagcgttta

SEQ ID NO: 320598 - DNA, 1131 bp, Homo sapiens
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaagagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattgggtgagtaccctaaaaatttaccttttaacttaaagaatgttaaaagtcctaataggaaatcattgtgaactcaggtaaaatcaagttttctgacatccccttggaaaattatgaaataactgaatattagaaataattagaaaaagggattacaggcgtgagccaccgtgcccagctttatgatcttaagatagactcttatcctttttgttctatagtttctatgtgtaaagtagattataaaaagaaataacccaagacagacagtatg

SEQ ID NO: 320599 - DNA, 348 bp, Homo sapiens
aacatttttgtttgactattaaatagctgttccacagccagtcccttcaagcaaaggaagatctaaaaaagtcctagaatcagtgtttcgtattccacctgaacttgatatgtctttattactggagttcattgggtgagtaccctaaaaatttaccttttaacttaaagaatgttaaaagtcctaataggaaatcattgtgaactcaggtaaaatcaagttttctgacatccccttggaaaattatgaaataactgaatattagaaataattagaaaaaggtataaagggccgggtgcagtggctcacgcctgtaatcccaacactttgggaggccgaggtgagtgg

SEQ ID NO: 320600 - DNA, 2396 bp, Homo sapiens
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaagagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaacctaaaaaaaaaaaaaaaaaaaaccagaaaccacacccaaaaaaacacccaaaaagcaaagcaacacccacacctgacagacaaggacaacaaaacgacgcgcgcccggctttaccgcggcgcccccctggccccgtctccccccgcacgagcgcccccc

SEQ ID NO: 320601 - DNA, 2016 bp, Homo sapiens
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 320602 - DNA, 996 bp, Homo sapiens
agcgggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggtaagaagaatatataaattacaattgtattttaaatatactttttctgaaagcttgaagttatatagttggaataaattattgacctctcaggatgggttcagtggctaatgccataatcccagcactttgggaggccgaggtgagtggatcacttcagatcaggagttcaagaccaacctggccaacatggtgaaaccccatctccactattagccaggagtggcggcacatgcctgtaatcccagctacttgggaggttgaggcaggagaatcgcttgaacctgggaggcagaggttgcaggagccaagatcgtgccactgtattccagcctgggcgacagactgatgagagtatctc

SEQ ID NO: 320603 - DNA, 1108 bp, Homo sapiens
tgcggccgccgtggccgagctgccggtgctggacgcccgcgggcagcgggtaccgttcggcgcgctgttccgggagcgccgcgccgtggtggtgttcgtgcggcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacaccaaaatgttgccagtaggaaaaaaaaaa

SEQ ID NO: 320604 - DNA, 949 bp, Homo sapiens
  misc_feature (70)..(71): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (108)..(108): n is a, c, g, or t
  misc_feature (116)..(117): n is a, c, g, or t
  misc_feature (155)..(155): n is a, c, g, or t
  misc_feature (937)..(937): n is a, c, g, or t
ctctctcacacgtacttctcttcccgtttgtgtttgtgttgtcatctaaggtcccgcgcttatactactnnttggttgtgttagacataccactgatnangccnaaangttttcgnngccatggataatcacggggaatccagtatttttgccanaagcttctgcagactgtttaggcaactttgatttcacccatatagagcgattttatggcaacagtcaggaatacgtccgggagcagacagcacatggttgagtatagcctcatatagggggccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacacctggcctcgttggcctcagcggtggagctctgcggcagaanccccaaaaaacc

SEQ ID NO: 320605 - DNA, 1133 bp, Homo sapiens
  misc_feature (1121)..(1121): n is a, c, g, or t
tgcggccgccgtggccgagctgccggtgctggacgcccgcgggcagcgggtaccgttcggcgcgctgttccgggagcgccgcgccgtggtggtgttcgtgcggcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacacctggcctcgttggcctcagcggtggagctctgcggcagaanccccaaaaaacc

SEQ ID NO: 320606 - DNA, 1229 bp, Homo sapiens
  misc_feature (1217)..(1217): n is a, c, g, or t
gcggccgcttcccaactagggcggggcagggagagggcgagggcgaggcccgcttcccacgcgccgggcgcccgagccgccggtcccggccccgcgggcgtcgcctttgctcgcgtcacgcacggcgaagtacagggatccttcggggcccgagggtgctgctttactaacttgccctttctgccgttttggctttcagcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacacctggcctcgttggcctcagcggtggagctctgcggcagaanccccaaaaaacc

SEQ ID NO: 320607 - DNA, 1001 bp, Homo sapiens
  misc_feature (989)..(989): n is a, c, g, or t
tgcggccgccgtggccgagctgccggtgctggacgcccgcgggcagcgggtaccgttcggcgcgctgttccgggagcgccgcgccgtggtggtgttcgtgcggcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacacctggcctcgttggcctcagcggtggagctctgcggcagaanccccaaaaaacc

SEQ ID NO: 320608 - DNA, 733 bp, Homo sapiens
  misc_feature (48)..(48): n is a, c, g, or t
  misc_feature (52)..(53): n is a, c, g, or t
  misc_feature (721)..(721): n is a, c, g, or t
tgttaggtggaggataattacatataagtaatgttttagaaggaagangggnngctttgtttacgtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacacctggcctcgttggcctcagcggtggagctctgcggcagaanccccaaaaaacc

SEQ ID NO: 320609 - DNA, 421 bp, Homo sapiens
tgattttagtaagcagtaaatctgatgaataatactatgcctcagccttttattcttattctcttctagggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttataca

SEQ ID NO: 320610 - DNA, 1082 bp, Homo sapiens
  misc_feature (1070)..(1070): n is a, c, g, or t
aggccctcggccgccccgcgtcatggccgcgccggccccggtcacgcggcagcatttcctgtgttacatctgcaaggaatacgtagaggatctggccaaaatccccaggagtttcttacaagaagcaaatgtcacccttatagtgattggacagtcatcctaccatcatattgagcctttttgcaagctgactggatattctcatgaaatctatgtcgatcctgagagagaaatttataaaagattgggaatgaaaagaggtgaagaaattgcttcctcaggacagagcccccacataaaatcaaatctactctcaggaagccttcagagcctgtggcgggcagtgactggccctctctttgattttcaaggagacccagctcagcaaggtggaaccctcattttaggtccaggtaacaacatccattttatacaccgcgataggaataggttggatcacaaacctatcaactctgttttacagcttgtaggagttcagcatgtgaactttacaaacagaccttcagttatccatgtgtgacttaaaatgcactcagtcactttcaactggaccttctggaatgtgaccttcaatgcctgggtgtaatatcctcgtgcagtgtctaacctgctgtcccttcccagcctttgaggagttagggaagcataaagggggcttgaacctgttgaattgcatgctgggaagcatcagttgtcaaaatatgttatatacttccattttataacttttaacattttatacaaaaaaaatgaatatacaaaatataactttaaaagctataaaatcataaatactctaaattattttacattatggtatattcagtcaatgaaagagttttttggcaatataaattctgacagtatataaggggacaggagaacaacacaagaccattatattcagtgaagaaggcaaaatatcaaatctgtcaacaatgtaactgcatttttatatgtatatatttgtatttttgtatgctttggaaaaagacaggaaataaacacctggcctcgttggcctcagcggtggagctctgcggcagaanccccaaaaaacc

SEQ ID NO: 320611 - DNA, 619 bp, Homo sapiens
tttctctgttttagagatgggatctcactttgttgtccagactgttctcaaactcttgtgctcaagtaatcctcccaccttaacctcccaaatgctagtattataggcatgagccaccatgcgtggcccttcccaagcttggaacttccttacctgggtcgtagatggactctaggagatctccaaacctcctgaaattgtgtgcaaaatattgtgtctgtatatgcattttctagggatgcggtttaatattttcatgtgattcctaaaagaatctgaggctcaagaaaagagggcatcttaatatcctgcactttcagtcattgagggcatgatcacaaagatcaaagccatttttaggcaggtgagttggagtggcagtcagaagtaggtaagattttctatttgtgaggcaggaacaagggattggaccattgttcttaaatactgctttcttacccaaaatgcaaatctgtgcgtaatcagtacacagcaaaaatatttactgtattttgtttttccccttgggtacatttggcaagtgcctttttctactataaccggcgtttttgtatctctttatttgtatctcaaactcactgggacttacaatcttaaa

SEQ ID NO: 320612 - DNA, 725 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagtttagcctatatcatcttggccagtccatggtctcctcagcatctaaaatcacatgtataggctaatggaaagtttactagccaagaataagtaagtgtggaatttaatatgatcttcacagtttgctccgaaaaaacaagaacttgaggataatactgatgtggtgctcagagaccctagggagagggaaggtagtttcaactgagaccgagcgtcatgaggaaactctgatgtagtgttcagccagaagtagactgatgtaaaatcatttgtgaactgcctacttaaatggtaaattttccataactagaagttgg

SEQ ID NO: 320613 - DNA, 204 bp, Homo sapiens
  misc_feature (28)..(28): n is a, c, g, or t
  misc_feature (30)..(30): n is a, c, g, or t
ggcgcgatggggacggtgtattttaatncncccgggttgttacaagttgagttgaaaacaagaaaaacttgcttttggcgccatcaaaaaggaaagccagatactttcctttctacaattgaagccatttactactttctggtagactaccatactgatatattaaaagagaaatacagaggtggcctcgttggcctcaagggg

SEQ ID NO: 320614 - DNA, 382 bp, Homo sapiens
taagtttcacataaactctctttgggtttgtcctggtgttgcctgaggttcttacagagaaacattttgaggctttaatagtcctgagttattcagatgatgggattcatcctaaaaaatgaaatttgagagttggagtggcagtcagaagtaggtaagattttctatttgtgaggcaggaacaagggattggaccattgttcttaaatactgctttcttacccaaaatgcaaatctgtgcgtaatcagtacacagcaaaaatatttactgtattttgtttttccccttgggtacatttggcaagtgcctttttctactataaccggcgtttttgtatctctttatttgtatctcaaactcactgggacttacaatcttaaa

SEQ ID NO: 320615 - DNA, 1668 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttgaaaaaaaaaaaaaaaaaaaaaaaaaaaaaaaaaaaaaaaaaaaaaaaaaaaagagagagagagagaagaagagacacgagaagaattcccagagggggcccccagaaggaactaccccctttttcggcgaaggggggccccccaaggggggccccgtataaagcacgaacggggccggcttaaacacacgttgataacggggaacaaacgggggcagcagggagaacctcggggaagaacaacccaaaaacaccccggggagctgagccaataatggggaacaaaacaccccaacaaaatatataagagcgccctaagaggacacctatataacactttcacagagacgttaaaggggcgtggaacaccaagccagagaaatacacgccgcgccgcagcaagaacacattggcgcgcaaccacggggatcatcctactgacgcaaattcttctaccaccggacactagtaacgacaaccccgcgacctacgcaccgagcaaagtacaagcaactagcacaacccaaagacaggg

SEQ ID NO: 320616 - DNA, 1166 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaaaaaagtcgacgcggccgcgaatttagtagta

SEQ ID NO: 320617 - DNA, 1452 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaaggtaaaaaaaaaatgtttttttggactgctcctccctcagacttattttgaaaaaacttcaaacttacagataatttgaaagaggagttacactgaatacctgtacattttgccatatttactttatttctctctttttattatatatgtgagtgtgtatttatatattatatattttttggttgatcaattgaaagtaagtttcaggctttgtaacacttcacccttaaatattaagtgtacattttcctttttttcctgggtgacagagtgagacctcatctctaaataaacaaaaaagtcagtttgtcaaggaaatgaaacccttctgaaaattggtgaatgcagtcctgtcagagatttagatttttgaagatgctgatacatagaagattggaagacatgaatatcttaaatgttaactacttttaattcattggtctaagactcagtgttaactgtcatgtataagattttattatttgttttatgttgcttctgtatataccttgaggtgtttaagaaaatatcttgtttcaaactgggattgaaggaagttatctgcagtctttaaaaaaaaattcttagaataattaagagaaatcattattattgtaccaagcctgtggttaagaagaaat

SEQ ID NO: 320618 - DNA, 2694 bp, Homo sapiens
tccgtgcgcgatcacggcccggcgcgtggctcgggctcgggcggagctggagacgtgtggagctgttcgaggactcgcgggtgtgcaggtctgagtaccactccgatccctggtggaggtccccgcgcctctctggagaccagtggtctggccccagagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattccggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaa

SEQ ID NO: 320619 - DNA, 2474 bp, Homo sapiens
ctcctagagtatccccactatcgctaagaaacccaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattccggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaa

SEQ ID NO: 320620 - DNA, 3122 bp, Homo sapiens
agacagttttgtgatataaagattacacctcttaggtctattgttactattttttaattgataattatttaatttgtgctattgaaaatgtgatgccgaaaatcatgatgtttcctgcaaaggataacagttttgacttgaaagtatgtctaaggaacagaatttcaacttgaattttagatctgaagctttttgcccaaacttacatttctttttaaaatagcgtaagaggccaggtgtggtggctcactggtaatctcagcactttgggaggctgaggcaggcagatcgcttgaggtcaggagttcaagaccaacctggccaacatggtgaaaacctgtctctactaaaaaaatacaacaattagctgggcatggtggcaggtgcctgtaatgccagctacttgggaggctggggcagaattgcttaacccaggagacggaggttgcagtgagccgagatcacaccactgcactgcagcctgggtggcagagtgagagtccatctcaagataaataaataaaaataaaataaaatggcataaaataggcaaacctaaagtttataggatttattaaaatgtccttggcacacatggtgaaatgcaaagaattggagttaatataacttaagtgaaaatgacattggagctttgctttaagagaagattctctgttaaatgagttgaaaatagttgtcctaatacatgaataacaatgccaaggaagaaatttgggttggttttgtaacaatcaccattcttaatattatggtatatcttttaaaccatatgcatatttataggagtttattgtgagcttcctatttagctttaaagaccctttttattaacataaaaattaaaatgtttatatatttttttatttgtgctttttttacctttagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattccggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaa

SEQ ID NO: 320621 - DNA, 887 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaatttttttgattggctggacaaaacaaaaaaaaaaaaaaaattgggggggcccgaaaatttaaactttggggggccagaagaaggaggcaagaaagggaggtgttcacaaaaagggggggtgaaggtgtgttgatacgcgaa

SEQ ID NO: 320622 - DNA, 871 bp, Homo sapiens
  misc_feature (686)..(686): n is a, c, g, or t
  misc_feature (695)..(695): n is a, c, g, or t
  misc_feature (697)..(698): n is a, c, g, or t
  misc_feature (703)..(703): n is a, c, g, or t
  misc_feature (709)..(709): n is a, c, g, or t
  misc_feature (728)..(730): n is a, c, g, or t
  misc_feature (736)..(736): n is a, c, g, or t
  misc_feature (751)..(751): n is a, c, g, or t
tccgtgcgcgatcacggcccggcgcgtggctcgggctcgggcggagctggagacgtgtggagctgttcgaggactcgcgggtgtgcagggatgcggtttaatattttcatgtgattcctaaaagaatctgaggctcaagaaaagagggcatcttaatatcctgcactttcagtcattgagggcatgatcacaaagatcaaagccatttttaggcaggttgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgnatcattttncnnggacncagtanctcataaagaatttttcannngcaaangggtccatatggtgnggaaatgtacctggagccatttaagcagaattgaaaagtcgggttgtgatagacgggggccctgaaattttgaggcggcccaaaattggggccgggcgttggaaaactggcaaacacttg

SEQ ID NO: 320623 - DNA, 2623 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattccggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaa

SEQ ID NO: 320624 - DNA, 982 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagaggtggcctcgttggcctcaagggg

SEQ ID NO: 320625 - DNA, 2681 bp, Homo sapiens
tccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagatgggaccatcaagttgcaggaaaaccagctcagggatcctgctgattttacattatgcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattccggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaa

SEQ ID NO: 320626 - DNA, 2753 bp, Homo sapiens
tccgtgcgcgatcacggcccggcgcgtggctcgggctcgggcggagctggagacgtgtggagctgttcgaggactcgcgggtgtgcagggatgcggtttaatattttcatgtgattcctaaaagaatctgaggctcaagaaaagagggcatcttaatatcctgcactttcagtcattgagggcatgatcacaaagatcaaagccatttttaggcaggttgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaaaactcttagcacctgaatttgtaaacatttacacgtatccgtgtattccagaatatgaagaaaaggaccatgaagttgcactcatttttcctggacctcagtctatctcaataaaagatatttcttttcatctgcaaaaaaggattcaaaataatgttagaggcaaaaatgatgaccctgacaagccatcttttaaacgcaaaagaactgaagaacaagagttctgtgattgtgaatgacaggcaagtgcaaaggcacaacactgaaaaaaattatatttatagatagcacctggaaccaaacaaacaaaatattcactgatgagcgacttcaagggttgttacaagttgagttgaaaacaagaaaaacttgcttttggcgccatcaaaaaggaaagccagatactttcctttctacaattgaagccatttactactttctggtagactaccatactgatatattaaaagagaaatacagagggcaatatgacaatcttttatttttctattcttttatgtaccagttgataaagaatgccaaatgctctggagataaggaaacaggaaaacttacacattagtttttaacaagccacttatgtctttttattttgctaacattaataaacttatatttgtgctttgttttttcttaagaaataatcatatataatgcctgtaagaccatttgaaaaaattccagtttcatatatatcacttcatatttcttgaaggaaattgtatctgggggaatttttcagagatactgttgattgaaaaacttacttcagaagttatttgctcagtgaaacctcagtttcattactacattttaatatagtgtgttatgtctctgtgattagatataacatattccattagatctaattagctatttatttcaacatctttatatcttttcacctgtactcatgaccacctttagaagtaaatggggttacaatctgctggctgaaaaataggtcataagtgatttttcttgaggttagtagcaaacataggcagaactagaattagaattccggtatctagggctgtttctttaagtcctaaggttgttaaaagcagagactctggagctagactacctgaatctaaatctcagcctttctgcttatcagccatgtcattttcttccatttgtacaaagcaggcaatactgagcaactaccttataggaataactgagttaatatctaaggggctttcagcagtacctgaaatatagtaagtgttacatatatgtttactctttttattttatttggaattgtgaactgataataattgaagcctacctgctagtggccatctctgctgccaggtgaaaagagcctgacttagaatgaagtcagcgaaggaaagcagagtggagagaaaaagagagactgagtcctgatgacatcatttatttacctagacctagctgcttgtgaatagagccctactgtgctgaatagcttctgtctgctcttttctattctgctccctgctctgtgaggtaggttcctttgctctcttgcttttggttgggttcaacaaatgggaagcaccagtgggagattagaagttgagaggaaaatgaaatgatgttatttatttccctggctcctttcctgccatgtcatcatcagttggctgtgttcctctactaaatagtaccttatcaggaatcctatctcttctgttcccaagcagttaccccagttacctcactaggtttagttcctgctccctccctttaccccttttcacttagggttggtaatagcttacagttattactagccccagtatagttcactacaacttgttgctttacctaaaccctgctcatacatttgtaaatactgtagttgttttattacactcttctcaaatgtccccacttgaaatagccttctatttcttttggggactctgataaattcacctgtttgggtgaaataatagcacatttcctgaagtatatacagtgggacacatgatgttttatgggggaaagagttcttggtgaaattagtttgctgtacattacgttgtttccctcccagggattcagaaggcaaaacatattaaaggttctgaaaagtcctgaaataaacattttgaactttatttaa

SEQ ID NO: 320627 - DNA, 963 bp, Homo sapiens
gacaaagccaggtgagggctggaagcgggctagggggatcaagctgcctccctcccttgtgtgccaggggtggtccccagaaggagctgatctgaacaggccggagagtaggaccggccgtcacacccccacacctccagcctcggccccactccttgggctcttaaggtcctgcctcaagaaccacttcctgagtcttagtgtatgtgtgtacacaaagaatgaaagaagtctctagagctaaaggaaggagatccgggctgggctgagaagcatcttccaggatcacggccttcccgcgggacacaccaagcccattccggatcttgctcttcctgaccatggctggcaggctgtggaggaggagcggagagcagaagaaaggagtattcatcaggttccttattgtgctgccactagatgccaggcatgtgctaggcttgggggctgcaaggagaggaagacagcggccctgccctctgctagcaggcagaaccgagttctggccacactgtgaagaaaggcagaagcctgcggtggcagctggttaagctcagagggagggaaagggagaggagaatggatttcacggagcagaaggatgtgctcaaggtgaccttggagaataaaggggagagctccagggacagagaagcagtcgactgtggaaaaaaaaggagcattttgtaaagtacatggcaggttggggttggctggctcaaagggcttgggacggatgtggtgagatgggctgaaggtggtctgaagatcaagattgagagactagatacataacaaccaactgcaatgtttggtccttcattgaatggttgaacaaaccagctgtgaaagacattttgggacatacagacatggactgagaattagacataagaaaattattttgttaactgttatcatggttaacaaaacggtcatataatatgattatgtagagaagtt

SEQ ID NO: 320628 - DNA, 474 bp, Homo sapiens
atggagagaggctgccccacaacagagatgacgatttaatagctgtgtttgagtctctttagggttgttagccagaaggtggagaaacagctgtttgccactccactgaagattgaatgagtagaaataggttcaccctgacatgtgagatgactgtcattatccctaacaacaacaatgacagcaataataacagctaatactattgagtctttataatgttattaattatttttacgtattttgctctcccaataaccatatgagagcagtattactattatctgtgttttgtagctgaggaagcctgctcagagcttaccactgatcagtggagaatttgggattcagactggcagtgagctgaccagtgtctgctcttgcctatcattttccactgggattgccactggaggcatttgggagcctgaaatgccttccctggaaggtggagaaatctccttccacaacctc

SEQ ID NO: 320629 - DNA, 417 bp, Homo sapiens
acccaacagtaacaaatttattttgcgttgtgatcccaaatgagcatgcacattggaaaccgaagcatcactttctcttacgatgtgcaagtctctctcatcttttgcatttttttcattttattctattttgttctttttttcaaaactgacgttgtgactcactaaattaatatcaatgatgggtcaccaccgggtgggtcccagagtttgacctaacaccaggtgatgagtctgtgtcatgtaggagccgagacagggtgacaggccaggactggggaagtggacgtttgctcagggaagactcccttctcctggtgcagtgaccttcatcacagcccttcccttctttcttctcagaattgattttaccctctccatgcagctaaactatgaaattcaggtgtgtgggtcaat

SEQ ID NO: 320630 - DNA, 3128 bp, Homo sapiens
agtcccatggggaatgtcaacaggcaggggcagcactgcagagatttcatcatggtctcccaggccctcaggctcctctgccttctgcttgggcttcagggctgcctggctgcaggcggggtcgctaaggcctcaggaggagaaacacgggacatgccgtggaagccggggcctcacagagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 320631 - DNA, 2737 bp, Homo sapiens
cttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaaaaaaaaaactgagactagttctctcctcgtgccgaattcggcacgaggtcctgttgttggtgaatggagctcagttgtgtggggggaccctgatcaacaccatctgggtggtctccgcggcccactgtttcgagcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 320632 - DNA, 305 bp, Homo sapiens
attggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagc

SEQ ID NO: 320633 - DNA, 3062 bp, Homo sapiens
agtcccatggggaatgtcaacaggcaggggcagcactgcagagatttcatcatggtctcccaggccctcaggctcctctgccttctgcttgggcttcagggctgcctggctgcagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgaagctgttctggatttcttacagtgatggggaccagtgtgcctcaagtccatgccagaatgggggctcctgcaaggaccagctccagtcctatatctgcttctgcctccctgccttcgagggccggaactgtgagacgcacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacagttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 320634 - DNA, 3196 bp, Homo sapiens
ccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacgggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcttgaatatccatgtggaaaaatacctattctagaaaaaagaaatgccagcaaaccccaaggccgaattgtggggggcaaggtgtgccccaaaggggagtgtccatggcaggtcctgttgttggtgaatggagctcagttgtgtggggggaccctgatcaacaccatctgggtggtctccgcggcccactgtttcgacaaaatcaagaactggaggaacctgatcgcggtgctgggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtgctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagccccacctgcacgtgatctgctggccctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaagtgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacaca

SEQ ID NO: 320635 - DNA, 590 bp, Homo sapiens
gtgaagagaaccaggaagctaaactttaaaatggagaatcaaagaataagagagctgaacatactgacatactgattctttgaagagaaacttggggttcactatatttaacaggatcaaagacactcctagaatatgcagagaaatggaaaacttcagaagatcctttacctttattggaggtatacacagtggctatccaaagttatgttaaagcccgaccttatcttacctctgaatgtgaaaatgtagccttggttctggaacgcttggcattaagctgtgttgaacttttactgtgtctgcctgttgagttatcagataaacagtgggaacaatttcagacactggtgcaggtagctcatgaaaagctgatggagaatggcagctgtgaattgcattttttagctactctagctcaagagactggggtgtggaaaaacccggtactgtgcactattctttcccaggaaccattggataaggataaaggattccatccaggataccacattacatttagtcgtcatgtcttcttaggctcctcttggctgtgacagtttttcagactttccttgtttttgatgacc

SEQ ID NO: 320636 - DNA, 8476 bp, Homo sapiens
  misc_feature (1443)..(1443): n is a, c, g, or t
aacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagnattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320637 - DNA, 6841 bp, Homo sapiens
gactagaggatccccaccggcaggtgtactggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320638 - DNA, 3720 bp, Homo sapiens
agcccactctagagtatccccctcctaccccacggatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320639 - DNA, 3817 bp, Homo sapiens
gttgagttgcggcgaaggcggctgcgtcgcggagctgcagcgcctgggcgagcggctccaggagctggagctacagctgcgggagagccgggtaccggccgtggaagcggccaccgactactgtcagcagctgtgccagacactcctagaatatgcagagaaatggaaaacttcagaagatcctttacctttattggagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320640 - DNA, 8499 bp, Homo sapiens
  misc_feature (1443)..(1443): n is a, c, g, or t
aacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagnattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320641 - DNA, 7625 bp, Homo sapiens
  misc_feature (569)..(569): n is a, c, g, or t
ggcatttaggtccatgcccaagtgacatcactgcccaggagcctgagaacctgcccacctgcccagcttaccactgccactaccagcacccaagcaagccacctggagttccaaggatcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagnattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320642 - DNA, 8441 bp, Homo sapiens
  misc_feature (1443)..(1443): n is a, c, g, or t
aacagttaagagagaggggatttatatctgctcggtttaggaattggcaagcctacatgcagtattgtgtgttgtgtgacaaagaattccttggtcacagaatagtacgacatgctcagaaacattacaaagatggaatttatagttgccccatatgtgcaaagaactttaattctaaagaaacttttgtccctcatgtcacactgcatgttaaacaatctagtaaagagagactagcagctatgaaaccattaagaagattgggaaggcctccaaagatcacaactaccaatgaaaatcagaagactaatactgtggctaaacaggagcagcgacctataaaaaagaatagtctctattcaacagattttatagtgtttaatgacaatgatggttcagatgatgagaatgatgacaaagataaatcctatgagccagaagtgattccagtccagaaaccagtacctgttaatgaatttaattgccctgtaactttttgtaaaaagggctttaagtactttaaaaatttaattgctcatgtgaaggggcataaagataatgaagacgccaagcgctttcttgaaatgcagagcaaaaaagttatttgccagtactgtaggcggcattttgtgagtgttactcatctcaatgatcacttacagatgcactgtggcagtaaaccatatatctgtatacagatgaaatgtaaagctggttttaatagttacgccgagcttttaacccaccgaaaggagcatcaagtctttagagcaaaatgtatgtttcctaaatgtggaagaattttttcggaagcttatttactatatgatcatgaagcacaacattataatacgtacacttgtaagttcacaggttgtggtaaagtttatcgttctcagggtgagctggaaaagcatctggatgatcacagtactcctcctgaaaaagtgctgcctcctgaagcccaacttaattcatctggagattccattcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcaggcaagctaatggaccattgtcaaatggtttggaaaaccctgctactactcctctacttcaatccagtgaagtagctgtgtccattaaggtgtctctcaatcaggggattgaggataactttggaaagcaagaaaactcaactgtggaaggcagtggtgaagcactggtcacagacttacatacgccagttgaagatacttgtaatgatttgtgtcatccaggtttccaggagagaaaagaacaagattgctttaatgatgcccatgttactcagnattctttagtaaattcagaaactctcaaaataggtgaccttaccccacaaaacttagaaagacaagtgaacaacttgatgaccttttctgtgcaaaatcaggcagcatttcaaaacaatttaccaacttccaaatttgaatgtggagataatgttaaaacatcatccaatctttataatttacctcttaagacattagaaagtattgcatttgttccaccgcagtccgacctaagtaattcattaggaactccatcagtgcctccaaaagctccagttcagaaattcagctgccaggtcgagggatgtactcgaacctataattcttcacagagtattgggaaacacatgaagacagcacaccctgaccaatatgctgcatttaaaatgcagcgcaaaagtaaaaaaggtcagaaagctaacaacttaaatacaccaaataatggaaagtttgtttattttttgccatcaccggtgaacagctcaaatccattttttacatcacagaccaaagccaatgggaatcctgcttgttcggcccagttgcagcatgtctcgccacccatttttccagctcatttagcaagtgtgtcaactccattgttgtcctcaatggaaagtgtcataaatccaaatataacttctcaggataaaaatgaacaaggtggtatgttatgttcccaaatggaaaatttacctagtactgccttgccagcacaaatggaagatctaaccaaaacagttctgcctttgaatattgacagtggctcagatcctttccttcctttacctgcagaaagtagttcaatgtctctcttcccttcaccagcagatagtgggactaattctgttttttcccaactggaaaataatacaaatcattattcctcacagattgaaggaaacactaattcctcctttctaaaggggggtaatggtgaaaatgcagtttttccttcacaagtgaatgttgcaaataacttcagtagcaccaatgcccaacagtctgcacctgaaaaagttaaaaaagaccgtgggcggggcccaaatgggaaggaaagaaaacctaagcacaacaaaagggctaaatggcctgcaattatcagagatgggaaatttatctgtagcaggtgttacagggcttttactaatcccagatcactgggtgggcacttatccaagcgatcttactgtaaaccactggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatacttgaggtaaaaagtggatctcagggtgctggtgaaacttcacaaaatgctcaaataaattataacattcagcttccttcagtaaacactgtgcaaaataacaaattacccgattcttctccgttttcctcctttataagtgtcatgccaacaaaaagtaacattcctcagtctgaagtatcacataaggaggatcaaatacaggaaattttagaaggcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattatgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320643 - DNA, 4572 bp, Homo sapiens
gtttcccaatcccttgagtttccaacaagatacagtgcttacagaaattaaaattagaaaatgacctatccactccagcatcccaatgtgtactgataaatacatcagtgacactgactcccacgcctgttaaatcaactgcagatatcacagttattcagccagtttctgaaatgataaacattcaatttaatgacaaagttaataaaccctttgtgtgtcaaaaccaaggctgtaactacagtgctatgacaaaggatgcactatttaagcactatggtaaaattcatcaatacactccagaaatgattcttgaaattaagaagaatcaattgaaatttgctccctttaaatgtgtagtacctacatgtacaaaaacatttacaagaaattctaacctccgggcacactgtcagttggtgcatcattttacaactgaagaaatggtaaagttaaaaattaaaaggccttatggaagaaaatctcagagtgaaaatgtgccggcctcacgaagtacacaagtgaaaaaacagctagctatgacagaggaaaataaaaaggaatctcagcctgctttagaattgagagcagagacccaaaatacccacagtaatgtagcagtgatcccagaaaaacaacttgtagaaaaaaaaagtcctgacaaaacagaaagttctttacaagtgattacagttacttcagaacaatgtaatacaaatgcactcacaaacacacaaaccaaaggacggaagattaggaggcataaaaaagaaaaggaggagaaaaaacgaaagaagccagtttcccaatcccttgagtttccaacaagatacagtccttacagaccttatcgatgtgttcaccagggatgctttgctgcctttacgatacagcaaaatttgattctccattaccaggctgtacacaaatcagatctacctgcattttcagcagaggtcgaagaggaaagtgaagctggtaaagaaagtgaagaaactgaaactaaacaaactttgaaagaatttcgatgtcaggtaagtgactgttctcgaattttccaagcaattactggcctaatacaacactacatgaaacttcatgaaatgactcctgaagaaattgaaagtatgactgcttcagtggatgttgggaagtttccatgtgaccagttagagtgtaaatcttcatttactacatatttgaactatgttgttcatctagaggcagaccacgggattggactaagggcaagtaaaacagaagaagatggtgtatacaaatgtgattgtgaaggctgtgaccgtatatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaagaaaaaatattgataagactgctgtgactagtggaaatcatgtatgtccttgtaaagaaagcgaaacgtttgtacagtttgccaatccatcacagcttcagtgcagtgataatgtaaaaattgttttagacaagaatcttaaagattgcactgagcttgtcttaaagcaacttcaggaaatgaaacctaccgtcagtctgaaaaaacttgaagtacattcaaatgatccagatatgtctgttatgaaagatatcagtataggtaaagccacaggcagaggtcagtactgataattaatgtagtataaatacatcatttaccattttattttaaataggaagccatcaagcatgctagaattgtgaaactttcattatatttttttgttgttgacatgaattaacctggccaaaaacaaaaaagaaaaaaaaaacatgacatttgtcatgtaaaacttttttttatccctatgggacttgaggaacagaatcagtacttcagttattgtaaatagtgagctaaacctcaaatttctatcacccagttgcccttttcatgaactaaacaattatctgtgtgattggtatgtttcaccaggtcactgctcatgtataacagtactctttatttgtagataccttttttgtatatatttattattgtaaatcatgtgctgccaccagcagtctgtaagtctaaactattaaatgacacatttatatttggaattttaatttttaactaagcgatcaagttttttaaattgttcttttattgttttaaattaagaactttttgaactaaaaccagaaactctgccatagttcattgatttttacatgaaacatttatttacaagatgatatcaagattacttttcacaaaataggcacattatatcaacactttgctctgctttgtaaatttgccatccaggattttggggtggtattcatgtgaaattaaagcagattctctagcagtttcctatagctacagtttttttttttcattgcttctaattggatatagttactatgagtccatgaaatacaatggaaatgtgaataaagaatttactacattgaagattttaaacatttggtattaaaaaaaaatcctttgtgaatgtgatagaaaactagtagtgtggagcagtgtaaatatttgaggtggtgatttgtgaagtagcccagtattgccttaaataaaatcacatttcatttcttgttttatacatgtgatcttataaagattttttgttttgttttgttttccattttctgagatttatagattggtgtatagctttaaactgtataaagttttgtggaaagatttttttaaacatttttataaatcttaaaattgatatcatcaaagtgagcccatcttgtgtttataaaatacaagagtccttaacatttataattacatagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaaaaca

SEQ ID NO: 320644 - DNA, 765 bp, Homo sapiens
acggtggctcacgcctgtaatcccagcactttgggaggccaaggcgggtggatcacctaaggtcaggagttcgtgaccagcctggcctgttaacatggtaaaaccctatctctattaaaaatacaaaaattagctgggcatggtggtgggcacctgtagtgccagctactcgggaggctgaggcatgagaattgcttgaactcaggaggtggaggttgcagtgaaccgacattgtgctactacactccagcctggatgacagagcaagactccgtctcaaaaaaaaaagaaaaaagaaagaaaacacctgagccctgccaagggggagctgtcttccccaaaccaacaaacctcctaaagatagctgggagcccatcctaccagctctgatttggggctggtttgtgagttactgttaggagtaagtccctagaagtgataaaagataaatcaacccaacgtttgatttataagatatatcagactgataactagtgacaatgttaatctaattacaattcaaaaatctcatcacatccattttccatgctatttcattaacttgggcttttgccaacaattcaacattttaagcgtgaccgaattcacgcttcattccttcggtgtgggtgatgacctgctccagggtgagggtctcagagcccctcttccacccagtggcccatatgccggccctagggagccctttttctagcccacaatcctttcccagcatcacagtctagagcacctccatctcctggt

SEQ ID NO: 320645 - DNA, 1013 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320646 - DNA, 1092 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggctgaagtggagagatcgcctgagcccaggaggtcaaggctacagtgagccgtgactgcaccactgcactccaccctgggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320647 - DNA, 651 bp, Homo sapiens
cggcacgagcggcacgagcggcacgagtggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320648 - DNA, 677 bp, Homo sapiens
ggaagttaatcctgcctatctgcctctcctaaccttggtcttgttttctggcagggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320649 - DNA, 1207 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggctgaagtggagagatcgcctgagcccaggaggtcaaggctacagtgagccgtgactgcaccactgcactccaccctgggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgcttatgaaagcgtcagacaaggacaagaaactctagactagtctcccccatccgtgcactgaaatttagaacagcgcggggggcgcttcagctaccctgagcacatcagcttccctcgt

SEQ ID NO: 320650 - DNA, 765 bp, Homo sapiens
ggctaggtagaggcggggtttatcggccgaggcggatcggtcggaaaggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgcttacgaacccagcttccttctgaccttcagttcacttggtcgcccttggagaacgctgtttctttaactaaaaataacagatgcttaaaaagaaagga

SEQ ID NO: 320651 - DNA, 415 bp, Homo sapiens
acatttagtgattttttttcatttttctcttttgcagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320652 - DNA, 1426 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggtgagcgtgcgccggggtcttgtggctggcggccgcccaccaccccacgccaggccttcagtcttccgaggatgaggggatctcagagctccggacagggaatcggtggtggctgggcgtggccgggcccgggccccagccgacttgagggtggaacccggcggcggaggcctctaaagcctgaccgaggcggggccgccggatcccgctgccccttgaccggaagcgggagcccagcctcggccaggaagagatgatgggcgaggggtgggcggcggcctgcagcctagagttttggggccttggtgcgcgatggcaaccctgccaacgtttcccgggagctcagtttgtggcaggctctgcaagcactttatgtatcttgtatttcctccgcctcctcccagctctgtgaggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320653 - DNA, 666 bp, Homo sapiens
taagtgcgcggccggtcggcccggatcggtcggaaatggctagagcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320654 - DNA, 1217 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggctgaagtggagagatcgcctgagcccaggaggtcaaggctacagtgagccgtgactgcaccactgcactccaccctggagatggagtctcactctgttgcccagactggagttcagtggctcaatctcagctcactgcaacctctgcctcccaggttcaagtgattttcctgcctcagcctcctgagtagctgggattaacaggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320655 - DNA, 1043 bp, Homo sapiens
  misc_feature (1023)..(1023): n is a, c, g, or t
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgcttagatatatcangggggatcctctagaacgcc

SEQ ID NO: 320656 - DNA, 1148 bp, Homo sapiens
  misc_feature (997)..(997): n is a, c, g, or t
  misc_feature (1013)..(1013): n is a, c, g, or t
  misc_feature (1088)..(1088): n is a, c, g, or t
  misc_feature (1147)..(1147): n is a, c, g, or t
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccgggtgcagccaatatgcttaactatactacagtgaacataaccacacttaaagtggtnggaaagaaaaggggtnagcaactttggaaaacagtattttgactaaataccataagagtaaagacaaaaagttacagtcttggatacaggnctttttggctttactcttatggggattttagtcaaaatggggtgccagccaatatgggna

SEQ ID NO: 320657 - DNA, 2249 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggtgagcgtgcgccggggtcttgtggctggcggccgcccaccaccccacgccaggccttcagtcttccgaggatgaggggatctcagagctccggacagggaatcggtggtggctgggcgtggccgggcccgggccccagccgacttgagggtggaacccggcggcggaggcctctaaagcctgaccgaggcggggccgccggatcccgctgccccttgaccggaagcgggagcccagcctcggccaggaagagatgatgggcgaggggtgggcggcggcctgcagcctagagttttggggccttggtgcgcgatggcaaccctgccaacgtttcccgggagctcagtttgtggcaggctctgcaagcactttatgtatcttgtatttcctccgcctcctcccagctctgtgaggcagaggtggaggagacactgaagcgactgcagagccagaagggagtgcagggaatcatcgtcgtgaacacagaaggaggctgggagcccttgggacactgtggagacaggagcaggccccctgctcagggctgcccctgatcagttgggtggcctgaggcaactcctttccccgcttcagccctcaactgcctcgagtcctgtgatggtccagggaatctcttttgggcacttcttgctctaagacctgaaagacttttgtcactaagagagaaactgtcttctgggactggacattttgactccaaggagacaaccccaggggccaacagccccagctgtgacccccaggcttccacatgaactcacaaaggagaggccctcattcttgccttaaaactgcccctaaagccaagccttttcactgggaagccctagctgcttaccttttggatactagtgagtgctgcttttttgtatactcatggggctgattgcaccatagctgagaacgtggaatgcagaatgagcccacctggctttgaatctgggccctacttaacttatcagctatgtggttttgggcataagccactttctctgttaagttttctcatttgtaaaatgtgggtcataattctgccttcctctaggggaagcttttagaatagtgcctggcatgaaatgcctatgaatgtctcagttagtgtgtgtgtgtctttaacttgcgtcccattctcagggcccccacatcagtgtctcgtttacatctcacacagtgaccctgcgaggcaagggtttgcccagtttgcagatgagaaacccaaagctgagagaggtgtggggaaccgcccaaggtcacccagctgtgaatgaacgtggtcagaacacagaatctgagttggtcacacttcccactgatccatggggcctttaagccctctggaagcttccattaaagatgattatttgaggataattgtattgggatgcctatgatcttatctagggttttcctacccatccccaacattcagctcagctgcctctttcttgaggacaccctcactgatcaccccagcccagccagagtggttgctcctgctcctgcccctgaacctatgacatacccaagtcccaatactttcgagccatctgccactgccttttgacatctctgccttggctagattcaaatggtgtttcataataaaagtctgagtttaagcagctttaccgaaaacgcaagggaagtttcattccatttatacttctccagaccccctgccatcctctgctgctacccacacaggcagaataaaaggcttaaatgtgtaagtcccatgaaggcaaagattggtctcttgtgttcactgctgtctgtagtacttaggatggtgttggcccagagttggtgtttgattaaagtatctgttgaatttttt

SEQ ID NO: 320658 - DNA, 793 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320659 - DNA, 909 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggtgagcgtgcgccggggtcttgtggctggcggccgcccaccaccccacgccaggccttcagtcttccgaggatgaggggatctcagagctccggacagggaatcggtggtggctgggcgtggccgggcccgggccccagccgacttgagggtggaacccggcggcggaggcctctaaagcctgaccgaggcggggccgccggatcccgctgccccttgaccggaagcgggagcccagcctcggccaggaagagatgatgggcgaggggtgggcggcggcctgcagcctagagttttggggccttggtgcgcgatggcaaccctgccaacgtttcccgggagctcagtttgtggcaggctctgcaagcactttatgtatcttgtatttcctccgcctcctcccagctctgtgaggtagatacaatctttagtcccattttgttatacatatctgttattcagcgccccgagaagccaagtgctttgccccaggaaatagtggagatggatttgaaccct

SEQ ID NO: 320660 - DNA, 670 bp, Homo sapiens
ggctaggtagaggcggggtttatcggccgaggcggatcggtcggaaaggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320661 - DNA, 1440 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgcttaaaaaaaaaacaaaaacaaaaaaaacaaagggggggggagctctaaaaaatccccctagggaggggcacccacgtgttatgcggcagtcacccagcttactggtcacaacaggtggccccctaattgatgaaagcctatgtaaacaggacatgagaacatggccggctggtaaacagacgtcgcgacacggggacaacactgggacacaccttggcgacctcctgtgcgtaagagcgaaccctttaatccctgtggggagggccgacaattctatggggacaacaactctcccgtcgagaagtaatctaacaggcccctggagggagactctactaccagctgtcagggcggtcaacaggtggtacaacacagcacacatgcataccctcatagaaattggcctaccgaattgtactcgacattttcg

SEQ ID NO: 320662 - DNA, 3050 bp, Homo sapiens
tgagacggagtcttgcactgttgcccaggctggagacagtggtgtgatcttggctcactgcagtctccacctctcaaattcaagtgattctcctgcctcagcctcccaagtagctgggattataggtgcccgccaccctgcctggctaatttttgtatttttagtaaagatggggttttgtaacattggccaggctggtctcaaactcctgacctcaactgaactgcccccatcgggcttccaaagtgttgggattagaggtctgagctactgggcccgggcaaacttggaaacatttttttccttcctagtgcctcagttttctcaaatgtaaaatgggaataaaatatctaccttgtaagacttttgtgagggtctaataactgttatatacattatctcatttaatcttcacaacaacctttaaaatagggatacgatcattctcaatttacagttgagtgaaagtgaggcagttcagatggcttgactaaggttacctggcatttgagtggcagagccaagatttaaacccagctctgtctgatgctagaccctttgcttcaaccatattctgtaatgtctcatttctaggaatgaatgaaggaatgttcacacatgtatcatccagcctctgaggtgcctctgacaaccataattgcctcctcatgaaaccgagcccagttcctcctgtggctcttcctgctgcagccgtgggccttgctctcctggctggaagcgctgttttcatcttatctggggattctcattgctgacggtgctggaggctgtggggcacagtggtttcaagcacaggctttggagtcaggcaaacctgggtttcaatatggctcaggaagctgttgggcaggaggacttttggtgagcaggcactgtctgataatggtgtttcccaggatcccaggtttcttgggggcacacaagtaggccaaagatgatctgggaacctcccagagaattgcctcatactgtactctccccaagaggctgcagccaagagaataggggccacgtcacgggggctcatgatggagtctgggctttgtgggaaaggaagtggggagggtctcagaaatgtttttacaatgtaaaatcttccagttagaactttatatgcaggatttaatcagaaggaaatttggacaggactcatttttctcattgctgctctaagtggctgctctaagcagtctggactgtctcccctgtggctttgttgagttcagtaaacatttattgtgcacatactgtgtgcaggcactttgctggggatacagggatgaaatagggacagtgcccatgcctgagggcattgccctgaagctggatgctaaggccatctgtgtgtgtgtctgtgtgtctgcatgtatctctgtgtctgcgtgtgtctctgtgtctgtgcttctgtgtctatgtgtatgtctgtgtgagtgtctgtgggtctctttttttgtgtttgtgtgtgtatctgtgtgtgtgttctctgtgtgcctgtatgtgtctttgatgtgtgtttctgtatgtgtctctgtgtgtgtctatatgtgtgtatctgtgtctatgtatgtgtgtgtcattttgtttgtttctgggtgtgtctacctctgcgtgtctctgtatacctgtatctccgtgtgtgtgtctgtgtgtgtgtatttgtgtgtctctgtatgtgcgtccgtgggtgtgtgtctgtgtgtgtgtgtgtgtgtattgagagggagggagaaagaaagggagcgacagatgggtcagcatggaaggtgtatcctcattcacagccctgggaggaatcagtcaatccacctactggtcaagaccaactctggtggtgcctggctgacagtgggaatgtgacttttcatttaagaatgggtttgcatttcctaggaaaagaatgtaggagttggagtctcaaggagtgttttttttttccttttgtgattgagagagcacagccttgtgtgcattggctgacagttaccaatctgcgtgttggggatagccacagagaagagacagagggaaccgcagacagtgagcaggagtctggtggaaccagtctgcctttaggcccaaacccccaactatgaatacctcaccttagggagctcagtcttttgtttgttcataaaaaaccaatctgggaaccagaggtggacaggaaagaggaggctgacctgctgctcccaggttaatgtgatcttggctggtgttgacaagtgtattatggttcatagcatagcacaaacccttagagattccccttgccctcaccggggtcaccacaccaaaccaggtatcttcaggagtgaggaccacaaaaaattggagatctcaccagggtgggcagagatttctttgttaaagtctgaaggagagaagactcaggggcatctctctggctccaaatctctgaagggccaaaggcagaagtgctgggggagtgtcaagttttcatttacaacagggacagcctgacagtggctgccttatgtggcagtgagtttcagtcaacagtcaacagaggcccaacgactactcaccaatgggaccaggtggccatagagggctggggagggcagagacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaacctatcacctagcagataaaactatggggaaaacttaaatctgtgcatacatttctggatgcatttacttatcttc

SEQ ID NO: 320663 - DNA, 674 bp, Homo sapiens
aggatactgcagaattcggctatacatgagtcgtattatcggtcggaaatgtgcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320664 - DNA, 1095 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaagtgtgtagaagtttgtggccgggcgcggtggctcacgcctgtaatcccagcactttggaaggccgaggcgggtggatcatgaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 320665 - DNA, 832 bp, Homo sapiens
tttagtagagaaggggtctctccatgttgcccaggctggtctcgaactcttgggctcaagcaatccttccgactcggcctcccaaagtgctggaattacaggcgtaagccaccgcgtccagccagaaccagcatcttttctgcacggctggagttgggaattttccacagcttagcgcactgctccttagcttttcgctttgccacagtggaaagcagattttccaagaatcctggcggagccaagatcggctcgcccgcccccgcctcacgctggctcctgataggcagctagagctgtccgttttgacagaaacctttgcgcagcgggcagaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcactccaggagtatatcactctcgacgggtatccactaacacccagtccatagccttgtatgtcctgcagctcgactttacgac

SEQ ID NO: 320666 - DNA, 503 bp, Homo sapiens
  misc_feature (60)..(60): n is a, c, g, or t
  misc_feature (62)..(62): n is a, c, g, or t
  misc_feature (101)..(101): n is a, c, g, or t
  misc_feature (103)..(103): n is a, c, g, or t
  misc_feature (491)..(491): n is a, c, g, or t
agagtatcatatgctggaccacattttagcttttattgttttttttttcccattgtccananagttaagcaacgagtggccacacttttacgtgactacancntggagttctgcaaagaaggaataatccaatactcaaggttgtgttgtgtgaggaagcaaagaaacacttacaatttattgaccacttctttcaagtcatttgtctgcacctctcgggtcatgatttccatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctggagaaaaaagataccgtcagatttaacaggttttacgttatccatttatccctcaagttctaattttaaaaagctggattgtcaaacactcattattaaatatanagtatcctaaca

SEQ ID NO: 320667 - DNA, 917 bp, Homo sapiens
aaatagcactttttatttgacactatttgaagtctgaacctttaaaccagattcttgggactggtggttcatatccatcagctcgttccaactttagcacctgtctcgtccccagtggcttttccagaactactgccttcaccatgaagctccatgagctttcccaattcaaacttgggcttcttcagcatttttacttttctaacgaagacatcatggagaggataaatagattggcaagccttttctatgtcttttccaatgctgtctggaatcaatttattgaccacttctttcaagtcatttgtctgcacctctcgggtcatgatttccatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctgccattttttgaccatggaacacattttgtcacgggtaagatccatgccatggaagttagtcaggcagtttttaccctgaacatcttcagtaatcagcttgaattttctaaatgcaacttcatcattctgcaaatcagcaagactcacttcaaacacacgacccttgagaccatcagatgcaattttggttccttgggtcctggtgacgagcgtctttccaatatttcttatattgaacatagcaggtgctttcacatcataccaatctttcttagaaaatggatcaaccactttcttcttggctccctttttgccgcctttcgtaaggcgcttgttcttgccaaccaccatggtgcttggcaagtagaggctgcagtgtactgtgatcacgccactgcattccagcttgggtgacggagcaagaccctg

SEQ ID NO: 320668 - DNA, 952 bp, Homo sapiens
aaatagcactttttatttgacactatttgaagtctgaacctttaaaccagattcttgggactggtggttcatatccatcagctcgttccaactttagcacctgtctcgtccccagtggcttttccagaactactgccttcaccatgaagctccatgagctttcccaattcaaacttgggcttcttcagcatttttacttttctaacgaagacatcatggagaggataaatagattggcaagccttttctatgtcttttccaatgctgtctggaatcaatttattgaccacttctttcaagtcatttgtctgcacctctcgggtcatgatttccatcatcttcttccggatttggctggtactgagcataagaggtcttccggatttctcaggacctgttggtgctgagcataagaggtcttccgtatctgattgttgcgttttttagtaaaaccaacacagaacagacgaagcaagtaaccatcggtagtcttgacatcaacgtgagcttcaatcattgtctgccattttttgaccatggaacacattttgtcacgggtaagatccatgccatggaagttagtcaggcagtttttaccctgaacatcttcagtaatcagcttgaattttctaaatgcaacttcatcattctgcaaatcagcaagactcacttcaaacacacgacccttgagaccatcagatgcaattttggttccttgggtcctggtgacgagcgtctttccaatatttcttatattgaacatagcaggtgctttcacatcataccaatctttcttagaaaatggatcaaccactttcttcttggctccctttttgccgcctttcgtaaggcgcttgttcttgccaaccaccatggtgcttggcaagtagaggctgcagtgtactgtgatcacgccactgcattccagcttgggtgacggagcaagaccctg

SEQ ID NO: 320669 - DNA, 294 bp, Homo sapiens
gaaataaaatataatgaccataagcatcatgggcaaggaatccaatgcttctagcttacttcatagctccatctaatcctctgtacaaagtgaaagctcaatgtcgattgactattgttgcttacaaatgctatgtactaaaaagcagattattttagtgtcttacacttcagcatataaaataaagtcttcattaggatagtagaaatgctgttgagttaaaattcatggattaatctcaaggatctagaactagaaataccatttgacccagccatcccattactgggtata

SEQ ID NO: 320670 - DNA, 643 bp, Homo sapiens
ttgaaattgccttttttttttgtctgtagcaaattttttactattggcaattttatgtggttcaacctaatagcttgaaaaagatttctaggttattctgaccaccctgcacccctgtcccatctctcacttccctgagaatctgcatttagaatagtgagctgtttctgaagcctttggactaagcaacaatgttgacaaacttaccttccaggagtctctgataagcacaacatcctgaagacatatccttgtgttgatgacatatgcagagaactttaactatagtgacttgcatctgtgtgtcagtacggtagagatagacttctgagttttcacctaagctctgcaagagagcctgatggtcctctatcctggttccatatctgtagtgactagctaaggacagtggtgccacccagtggcacgttatagacaagctgctgatgttgctttagcactcttcactgcatcaaattctttcctttcccatccctttcccttccccttcccttcttcccttcttcccttcatccctccttccctcccttccttcctctctccctttcttcccttctctcttctctcctccttccctccctcccttcttcctttctttttgttttctttcttttctcagggt

SEQ ID NO: 320671 - DNA, 958 bp, Homo sapiens
atggccatcatccctgaaattattatgctacaaagatgtggaatacacattcttttaaaagtcatgggacatgttttaaaaaatgaccacctaccttccagataactgaagacagtggagagttggtagtacagtaacctcttcaaatctcctccccaatggatatgaaattaatttaccactaataaatttctattcaaaaatatacactcaacatcacttgaagacagagaatgacatgactgcaaaataactgtaagttctgcagtccttcatactcctgcccctttcctgtcatgctgcagtgctttgtggtatacacacagaaactgggaatcacttagggaggaagaagagggacactggcaagggaacttaaggaacagttggagagaccactgtataggtcagatatacctcaaatctgaaaataccgaaaaagaaactgggaagatgggatgaagattgtgggaaaaggtttcaaagtatgtgctatttagagggtcaaattaacaattttatgggacagtcctccaattgcattgcttttcagggaggggataaaaggtaaaaaggaacgaagagcgattctttggcaatgaatgggaaaggagaaaagaaggaaaagggttaaattagggttctgtaaaacaaaggagaaccacaaacttggaggactcaactcttctcccctactactaaaacaaataaacgtataaaagaaataattttgctgacacctggaatttgccagattgaccaaaaaaaaaaaggtgcctttaaactaggaattgtgtaaaatatcctcacatcacaaaataaaaaaaggaaaataaaaaatcatacaaatctattgaaaaagatcagatagtgaattttcatacaaatcaatggagggaaataccaccttcacccccaccccccaccaaaaaaaaaaaaaaaaaaaacaagaagcaga

SEQ ID NO: 320672 - DNA, 341 bp, Homo sapiens
ctgaagtgttgggattgcaggcgtaagccaccgcgcccggccccacccagctcaaattctgtggtcatttttatcacttgcttgtttgccctttcatttcttccttgtgcttgttggtaaaaccacaatctcttacatctgactgtctccctaccctgcccctgaacatggcccaagaagaacacatccaagctgactggtttcacactaaattcatgactgcttagctcaagtgaaccctttctgcagtccagaatacgtgtccacttctaaggacggtttcatgtcttatctccgtaaacctcctgtacccccaaccctaatctcggttacagctgatg

SEQ ID NO: 320673 - DNA, 171 bp, Homo sapiens
atgggtacattggctcacatctgtaatcccagtattttgggaagccaaagtgggtggatctcttgagctcagaagttcgaaaacagaaagtggcaatatggtaaaaccctatctctacaaaatacacaaaaaaactagttgggcatggtagtgcatgcctgtggtcccagc

SEQ ID NO: 320674 - DNA, 454 bp, Homo sapiens
ttgctcttagcttagtaaaatttagggcaatccatctcaaacttgatggaagaaggactgtgaaggcttaacctattatcctttgaaaagataatattcctttgaattgttatgtttcattgtaacatcacagagtgaccattttgcagtggtcaccctaacaattccgtgccagttttaccatacaaataacatatttgtgcatcctcaccaggggaactacatttttttctttttaattatctaataaatgaatattacaagaatattcatatttatcctataacaggccatgtttaccctataaattccacttaaagtcttaaagttcaagtgtctcagcttcataaagtgactataaatttttaatgtttctattgattcctttacaaatttattcacaagttctgttaaatcaggggttcccaaacttaagtgtataaactctgaatca

SEQ ID NO: 320675 - DNA, 387 bp, Homo sapiens
ccagtagataagattaaacggaatcatacaaatactccattaattctaagaaaggagaaaaggagaaataatggcatgaacaaggaacaaagggggcatgtagaaaacctattaaaatggtagagttaatcccaactatatcaacagttaccactccatttaatgtcagactggattaaaaaagcaggatttatctatatgatattttcaagagagaaactttaaagacactggttaaaagtaaaaggatggaaaatgagatactatgcaaaacactaaacatagcaaaaactggtgtatctgtataagtatcaaaggagacttttaagacaagaaatattattagagacaaataggaatattttgtaatgataaaagcatctattt

SEQ ID NO: 320676 - DNA, 269 bp, Homo sapiens
cacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcat

SEQ ID NO: 320677 - DNA, 369 bp, Homo sapiens
gttttttcttttttttttgagacgaagtctcgctgtattacccaggctggagtgcagtggcatgatcttggctcactgcaacctccgtctcccggattcaagcaattctcctgcctcagcctcctgagtagctgggattacaggcatgtgccactactgcccggctaatttttgtatttttagtcgagacggggtttccctccgttggccaggccggtttcaaactcctgacctcaagtgatccactggccttggcctcccaaagtgctgggattataggtgtgagccacagcgcccggcctagtttaaatttttcttagtgtgaatgaattacatcctttctaccagcgttgtttaatcttacctcag

SEQ ID NO: 320678 - DNA, 722 bp, Homo sapiens
aaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagttttttttt

SEQ ID NO: 320679 - DNA, 277 bp, Homo sapiens
attttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtat

SEQ ID NO: 320680 - DNA, 210 bp, Homo sapiens
cccagcaggttgaggcttcagtgagccatgattgtaccactgcactacagcctgggtgacagcgagacactgtcttaaaaataaagatgagagagacgagcacatcttgaaatgctaatggaaaatggggagtagatggagaggaaaagaaagtacaggtgagaaaagagattactggtggtgtaaggataccaagaaggttggaaagga

SEQ ID NO: 320681 - DNA, 3635 bp, Homo sapiens
attcactgctggccagtgcctgcctttttcaccacctctaatttcagcttcagcagttgcttggaactttggttctggcagcagcagcaacatcattaccgctagcggcagttttgtgccgaggcacctacacacctcccgtcctctctgccagatcgcgggcctgtcggtgtctgctcctacacgccaacgccggtgggcaggaccatgtctctggtaagccagaattcgcgccgccgccgccgccgcgttgcaaaggctactgcgcacaacagcagctggggcgaaatgcaggcccctaatgcccccggtctccccgctgatgtgccaggctcagacgtcccccagggtcccagcgattcccagatcctccagggcctctgcgcctctgagggcccaagcacctccgttctgcccacctccgctgagggcccaagcacctttgtgccgcccaccatctctgaggcctcaagcgcctccgggcagcccaccatctctgagggacctggcacctccgtgctgcccacccccagtgagggcctaagcacctccgggcctcccaccatctctaaggggctgtgcacctctgtgacgcttgccgcctctgagggccggaacacctccaggccgcccacttcctctgaggaacctagcacctccgtgccgcccaccgcctctgaggtaccgagcacctccctgccgcccacccctggtgagggaacgagcacctccgtgccgcccacagcctatgagggaccaagcacctccgtggtgcccacccctgatgagggaccaagcacctccgtgctgcctacacctggtgagggaccaggcacctccgtgccgctcgccgccactgagggcctgagcacctccgtgcaggccactcctgatgagggaccgagcacctccgtgccgcccaccgccactgagggcctaagcacccccgtgccacccacccgtgatgagggaccgagcacctccgtgccggccactcctggtgagggaccgagcacctccgtgctgcccgccgcctctgacggacaaagcatctccttggtgcccacccgcggtaagggatcaagcacctccgtgccccccaccgccaccgagggcctgagcacctccgtgcagcccactgctggtgagggatcgagcacctccgtgccgcccacccctggtgggggactgagcacctccgtgccgcccaccgccactgaggagttgagcacctccgtgccgcccactcccggtgagggaccaagcacttccgtactgccaatccccggtgagggactgagcacctctgtgccgcccaccgcctctgatggatcggacacctccgtgccgcccactcctggtgagggcgcaagcaccttagtgcagcccaccgcccctgacggaccgggaagctccgtgctgcctaaccctggtgagggcccgagcacattgtttagctctagtgcttctgtggaccggaacccctccaagtgttcccttgttttgccaagccctagggtaaccaaggcctccgtggactcagattctgagggtcctaagggtgcagaaggccctatagaattcgaggtcctgagagactgtgagagccccaactccattagtattatgggcctcaatacttcccgggttgcaattaccctgaagccccaagaccctatggaacagaacgtagctgagctgttgcagttcctgctggtgaaggatcagagcaagtaccctatccgggagtctgaaatgcgggaatatattgttaaagaatatcgcaaccagtttcctgagatactcaggcgagcagcagcccacctggagtgcatttttaggtttgaattgagagaacttgaccctgaggcacacacctacattctgttaaacaaactgggacctgtgccctttgaagggttagaagagagcccaaatgggccaaagatgggcctcctgatgatgattctaggccaaatattcctgaatggcaaccaagccaaggaggctgagatttgggaaatgctctggaggatgggggtgcagcgggaaaggaggctttccatttttgggaacccaaagagacttctgtctgtggagtttgtatggcagcgttacttagactacaggccagtaactgactgtaaaccagtggagtatgagtttttctggggcccaagatcccacctagaaaccaccaagatgaaaattctgaagttcatggcgaaaatatataacaaagatcctatggattggccagagaaatacaacgaagctctggaagaagatgctgccagagcctttgctgagggttggcaggctctccctcactttaggaggcccttttttgaggaagctgctgcagaggtaccatcccctgattcagaggtttccagctattcctcaaaatatgccccacattcatggcctgagtcaagattggagagcaaggcaaggaagctggtgcagttatttctgcttatggattcaactaagctgcctataccaaagaaaggaattctgtactacattggccgagagtgcagcaaagtgttccctgacctcctgaatcgtgctgcccgcaccctgaaccatgtctatgggacagaactagtggtacttgatcccaggaatcactcctatactctgtacaaccgaagggagatggaagaaactgaggagatcgtagacagtccaaacaggcctggcaacaactttttgatgcaggtcctaagcttcatctttattatgggcaaccatgccagggagtctgcagtctgggcctttctgcggggcttaggggttcaagctgggagaaagcatgtgattacctgcagatacttgagtcagcgctatatagacagtttacgggttcctgacagtgatccagtgcaatatgagtttgtatggggtcctagagcccgtttggaaacctctaagatgaaagccttgcgatatgtggccagaatccacagaaaggaaccacaggactggccacagcagtacagggaggcaatggaagatgaggccaatagagctgatgttgggcacaggcaaatctttgttcacaacttcaggtagaggaatgcatggcagtcagaggggccttgcaaggaggggcctttgagcctcagttctcatgtattggggggtgggggtgggtacatattgtatttggtatttgtgttccagttatatttatgtcttttcatatttagttctggtgtggtgtctggaaatgtttcaactgttttaatatattgtctgattgggtaaatgtgattgaccacttgctgtctctgttgtattttggtatgagttttgatagctctataaaatgttttggaaatctttccatcttgttgcattatctagaaaagaatatagcatatagctatagatataggcttttccttgaaagcttgaaaaaaattcgccagtaaaataatctagcttaaagtgataaactaacaaacaaatataacaacaactgaaaaggcactctaaattgtggctggcttccctttctgtctgctattgtatgaagaatactgatgtttacctgtatttgctttgctgtactaaaatgtaatgaaaaataaaagattaataaatgaaacataatgctaaaacac

SEQ ID NO: 320682 - DNA, 603 bp, Homo sapiens
ataccctgtactatctgctcagttttcctgtaaatctaaaaatgctttaaaaaaaattaagactggccgggcgcggtggctcacgcctgtaattctagcactttggcaggctgaagcaggcaaaatgattaagctcaggagttcaagactggccttggcaatacagcgaaaccccaactctacaaaaatacaaaaattagccaggcgttgtagtgcgcacctgtggccccagctactcaggaggagggggcaggaagatggtttgagccctggaggttgaggctgcggcaaaccgagatcatgccactgcactccagcctgggtgacagagtgaggcctgtctcaaaaataattgattttttttttttaagagcatgaacatgaggtcaattttcttgactggcttataaactacctcttaaactaattccaaagaagtgtagtcctatcgtctttaacaaagaaggtggcactgaaacgtgtgaatggggccgactgggggagtgagtttgaactaggatctctagctaaatgtgtggcacgtgttttttaaacttaatctcatgcatttatattcctccttttatacaacactaacatgtt

SEQ ID NO: 320683 - DNA, 382 bp, Homo sapiens
cgccaatccccgacgggcccgtcttccagccccgaagcggtcacctcctgacctctagtggcgagcgcggggaactgcgccccggcccgtccgcccgccgagcccgggccgtgcatgccgagcccgttgttccttcgcaaaccgagtgaacctcccgatgcatggactctggctgtcgtcgacgcagactctcgtgcactgcttaaccccgttttgctgccatgtgacggctgcagacactgtcctcaaactgcagtcccacagacaagttttgtattttggtctgacctacccgaaggtgtcctttttaagtcttatttgttaatatttataatgacatataatccaaagtaaatggaaacgtcatattgcgatctcattg

SEQ ID NO: 320684 - DNA, 714 bp, Homo sapiens
aacccacattagaaaatcaagtgtaatccaatcaggaggtgaagagaggcttacgaaagcaatgtattagagaggaaagaccagagcaagattttgaagagatagcttctctgggacatgaagcctggatgaagaagcactgtgcatagactccaggggaaaatgaaggaagtgacaaagggagcattcactcttctgcattggagattggatttcccgacatgaaattataaactaagtaagaatgctgagtacagaaggatccaaagtcgtggaagacatcgccatgtgaggaaactgggtgaagagttcaagggaatctacgtatgacttttgccacttcttgtgattctagtaattttaaaataaaaagggcagtggaggtgaaacacatatcaatggtcagcactgagttctctgagtggaaggaagatttttgaagacaaaaaatgctggctagaaacaactccttagtgactgaatttattcttgctggattaacagatcgtccagagttccggcaacccctctttttcctgtttctagtgatctacattgtcaccatggtaagggagaagaagattctttgactacatgtggtcaacgtagataccttcaccaccagttctacctccagggcagtggaggtgaaacacatatcaatggtcagcactgagttctctgagtggaaggaaggtgagttaatcaagtttc

SEQ ID NO: 320685 - DNA, 700 bp, Homo sapiens
cagacaagcctgactgcatacatatctttaccacctcttccttccctatgctaggtatcacccatcagttgcagcaccgtattcttactgatcccaggaacagcctccaagtccctaacacagggatctaggcagtcagtgtcaatcaactggggtcggtaagagaattgaaacctatttttcatcccttcaggtgtttgcacccctatttcttttgtttttggggtcactgcagtgggcatgaatgctctgaggaacttcatcagccatttaactggagtcttatcatccatcatgtatctgtagattattactgagtaggcagtgctttgttttaacagctcctgtctttcctgtgctgaatttataatcatctatgagatggggtgctggatatttatttcataccaccctggacttttcccattaatccaacactgtgctgaagcctgtgctgggttttggacttattctttgtagagtctgtcagacaggagtgtagtccacttatagatggaacaatttaggcaccaagaagataaatgtataggcaaaaggcagaaagccaagagtgagtccccacttcccaagcttcagcaccaacctaatatacctttctaacacctatcacacagtgttttctcaaattctcagctttcacatgcagttctttctttatgttaattttctcaaagtttaa

SEQ ID NO: 320686 - DNA, 1447 bp, Homo sapiens
gtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagctaaaa

SEQ ID NO: 320687 - DNA, 1663 bp, Homo sapiens
cagttaaattgcatgagtaaatgggagagagggaaacttgcatggagaaaaaaagctactatgtgaaatttttaaatgtatgatattgttattccttggaaggaaggaaagaaatttcttgtaatttagacaggcctcatgttttgctaaagctttaacttagaagaggagaaatctcaatgtatcattctttaactgaatgcttttcttctacttgtccctagtgttaaattcctttcttctcctcttctcatcttacatggagaggatgacaggacagtgcctttggagtatgggaaaaaggtaaactaagggctcaatgctgactgaaatatactatactcatttcaccatttttttcattcagccaaactttgattagagccgaaaggagggtctctgacattataggagattctctacacccctaaatagcctctataggtttataaaatgggtatcagcatccttggctacttagctcaaaggagtgtttgtggcagagcctggctcctcatctggattgtgtggagctgcaagtgtagggtatcccaggctgctgtgggaacctccatgtcgtctctactgtagtggctctaaaatggaagacgcagactttttccttttaaacaaacttctactagagtgggtccataacaattccttggcattttgcagggaggttcaagcagggaaggatgaggttttatcagtattctatattagctgagcagcattcagatctttagctgtagagacaggcaactgggacatggagagttttctgtctctgacttaatggaacaaactccccaagttagctgtttctgtacacttttagggaaattggactagaaaaatctacagctttgaatggccatcctttgagtctctttctgtcgcttgcagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagctaaaa

SEQ ID NO: 320688 - DNA, 1147 bp, Homo sapiens
cacggacgcgcatgaaatttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccgatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagggaaattggactagaaaaatctacagctttgaatggccatcctttgagtctctttctgtcgcttgcagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagctaaaa

SEQ ID NO: 320689 - DNA, 920 bp, Homo sapiens
gtggccgcctggtgggacatggtcgaccgcaacctgggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaagtaagttaatgatgaaaagacatgcattattactgtatctaaaggattctaggggcaactatcatgtgacttactggatggtgacatgagacatcctgaatatcattcttattcttagaatattgttctgcgcttcttagatgggcactaagatttgggtaaagtatctatgaatttttagtatttgctattttcctcatgtctaattcaatgacttcaccaattcagtactctctctgaattcataaacgaagttgtatatctatagcctatcaagaccttttaaagggcttggtagtgttagcgtatgcctataatcctagcactttgggaggctgaagtgagaggatagctt

SEQ ID NO: 320690 - DNA, 397 bp, Homo sapiens
ggcagcttcgcacagactgaagctggtaaaggtatgtctgaagaggcctcaaagcacccatttcataagtctgtttgatatgtcataagattttcctcaggccctccgcgtggttgttttttgagaggtctccagggtactggtcagggtgggttgtggtgtctggggctcaaagtcccaccggtggacttctgctcctacactgatcaaaacagaaccgagcttctctaggtcccaaagtaccttcgtgaacttaataacctcattgccaaatggaggtgaagacatttttatttgctttctctgagggctgggggatgggttgagagaggttttttttgttgtcgttgttgtggttgttgttttttgagattctgttgcccaggctggagtgcag

SEQ ID NO: 320691 - DNA, 388 bp, Homo sapiens
gtctctgacttaatggaacaaactccccaagttagctgtttctgtacacttttagggaaattggactagaaaaatctacagctttgaatggccatcctttgagtctctttctgtcgcttgcagctctatgaaattgcacgcaatgcatacaggaacaaagagagggtcaagatggttatctttcctcctggcttccaacacaacctgctttgtaaaagccccacactgttaataaccgtgaggtaagagttgctttgctaaatgtatgttgcccttcaaggcaattagggctgctctggcttacttaggccacaacatgaaaatgtataatattttgcttatttaggtagggaaagggtgtgagctgatctgggtcctttttctacag

SEQ ID NO: 320692 - DNA, 596 bp, Homo sapiens
gtggccgcctggtgggacatggtcgaccgcaacctgggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtcctt

SEQ ID NO: 320693 - DNA, 1398 bp, Homo sapiens
gtggccgcctggtgggacatggtcgaccgcaacctgggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatgagtctgggaggagtggaaatcttcaatgaagacttggcccaaacaccacctgtgatgtatattgttctaatgtaaaattgtactgggctggtcggatgagctgaggccattgacttctctacaaatcacttgccattttaacaacagaaagtacgaatgttaggcagtatggaatgttcttatttagcttatcataatctactttgtaaaacatgctgaaacctcactgtggagaaccagaatttggtaaaatctagatcctatctaaaaatatgtagttattaaacattctgtggatatttgtgaataaggtagttgctatggtccgaatatctgggcctgcccccccaaattatgctgaaacctaatcaccagtgtgatggtaataggaggtgggactgagctctgatgaatgagattagtgcccttataaattatgaccaaaagagctcttcactcctcctaccatttgaggatacagtgagaagccttcatctatgaaccacaaagtagccctcatcagacactgaatcagccagtgccttgctcttggacttcccagcccccagaactgtgagaaataaatttctgttgtttataagctaaaa

SEQ ID NO: 320694 - DNA, 255 bp, Homo sapiens
tttatgttttactgttttgtttcttaattctttttttaaaaaaaaattctaaatctctttattttttatcttttaagacacaaagtcaaagggaaaatggaaatttctaaacctcatttttctctcttgctttttactttctggttctttgctttttatctttgtatttaccttctacttttttttttttttccctcccactaagtcaaatcttaatcagatcatggtggaatccaagggagggagggacccgag

SEQ ID NO: 320695 - DNA, 611 bp, Homo sapiens
cgtgctcaagctgctcggctgcacagctaggattccaacccaccagtctggcctgagtcctcttccttctcagcctggctctacgccttagcaaatcatgctggtttattggaaggtcagcagttccatatgattcagcacatgagtctttggcagaatgaagtccatggaaatccaaccactcgtgaagaatgcacaggggaataagggcagaaacgcccattcccacaggatctgcatggaacctcctgggaagcaagatgggaaatgcgaagagcactgggcttggcctcagaaacttcaagcgctttctgccctgccatgggctagctcgtgacctcaggcaagtcactgcaccctgcctctagctctgtgaccttacagagttgttgccaggataatgcttgggaaagtgtcttctgaactcttcaatgacctataaacctaggtaatatttttattgtgtttctcttcattgatagcctttttctaccactctgttctggcttacctggctagataagcagacttcagggggatctagggggtccctaaaattcaatgtatgaatggcttctgtttttgttgttttgttttgttttttgaggcag

SEQ ID NO: 320696 - DNA, 222 bp, Homo sapiens
aaggccaagggaggggtgttgatgtgaagacgctggggacatcatctgtgaagacaggccagccctccccttctgctggagcctcagtgtcccctcaccattctgcgctggtccagagatttcctgctattgatacttatcagagacacaaagctgaggaggaacagatgtgccatgtcatcagccataatagaaaaagtgcatgaatcttttttggaccag

SEQ ID NO: 320697 - DNA, 6133 bp, Homo sapiens
cgcactcattcattaagtggcactgctcagtggtgcgggggtgggcgtgcttccgtgggctgggcgctgggttcgcggcgcgccctcctgctgcctccccggagctcccgggccagtagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320698 - DNA, 4492 bp, Homo sapiens
agtaacctacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320699 - DNA, 6103 bp, Homo sapiens
cgcactcattcattaagtggcactgctcagtggtgcgggggtgggcgtgcttccgtgggctgggcgctgggttcgcggcgcgccctcctgctgcctccccggagctcccgggccagtagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320700 - DNA, 3456 bp, Homo sapiens
cggctggcattttgctcactccttgtaccccttagaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320701 - DNA, 3507 bp, Homo sapiens
gagaaatcacatagatcaagtacttagattgttggtaaattgctatttgcaaatatgcgtgtgcacatgggcatggctttggcatggtgggaggaagggcaggggcactagagtataacaaaatgttttagaacaagttttgatgtgtttgccattctgatttattaaatttaaggcatgtgaaatatgagacgaggtgtgtctcatgtctgtatttgaagcctgcattgacattattcatttcctgtgtttaaggagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320702 - DNA, 5115 bp, Homo sapiens
cgcactcattcattaagtggcactgctcagtggtgcgggggtgggcgtgcttccgtgggctgggcgctgggttcgcggcgcgccctcctgctgcctccccggagctcccgggccagtagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaaaaaatttaagtgggggtgccctcttttgggttataatagttcctatattttctctttggttttgtgttaggacaaagcctgtgccattttctctgtgttaaatattaggctctgtggacaataaaggatatactttaaaacaatgtgccccaaacattgttccaacatttccagcagagaattgcccagaatcttatttatctcctaaagtaatctattcggaagtagatcggctcgtttcatactgtggtcccatttcaacaacttggtggtgtcccagtaaaagctacctgtaaaattttccagtcccaaaaaaaataaaacgctcctccagggcagactttgaaataaaaacccagctgaacttttcagaaaagtgaacaatcttagatgctttaccatttaaagcctgaccaagctcttagataattccttaccagtttcctggtggccttttttaccggggacctgatcctccttatttgaaaccttgcatgatctgaccatacacggggggactgcgccttaatatacactgagaaacggcaggggcaaacaagattccataccgtatgctatgccatatgagacccccgtgagcgacgggcacgaccccgtgcggcaaagaacaattgcctccgtgtgacctaaaacacctttttaatccccactaaattgagtcttcccagccgataaacaaaatttagttactctccaataagtaccgcgaacattctggactatatgtgtagcagaacaagactctccccacaaaaacatttatacgagcgcgaatagagac

SEQ ID NO: 320703 - DNA, 4672 bp, Homo sapiens
cgcactcattcattaagtggcactgctcagtggtgcgggggtgggcgtgcttccgtgggctgggcgctgggttcgcggcgcgccctcctgctgcctccccggagctcccgggccagtagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaatttaggggggcccttttgggtaaatagcttgcctattacctgtttggtaggaacaagcctgcattttgcctcggtaaatatgggtcctggacctaagggaataccataaagaaatgcccaaattgtcaacttcgcgcagaagattgccccagaattctttttgacctcctaaggacattttcgcaaggtgaatgccggcttaatattggtggccactttaaaaattggtggtgtcccgaaaaggttacccgcgtaaaattgtcattcgcaaaaaaataagaggctctcagggaagcacgtgagttaaattcatgacacctcgcacacataacctcatgattggttcaccctttagcatac

SEQ ID NO: 320704 - DNA, 2580 bp, Homo sapiens
ctctctctctctctctctctctctctctctctctctctctctctctctctctctctctcatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320705 - DNA, 2156 bp, Homo sapiens
tcttctccctctcttactatgtataaatccgcttaattctttcttgccaccctgatgggagaagatggtcttgctcccatcagactgctgttttgataaccaacaagaggtcaatgtatagaaatccctgatgggacgaagacgcagtcttctcccatcggacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320706 - DNA, 3399 bp, Homo sapiens
cgcactcattcattaagtggcactgctcagtggtgcgggggtgggcgtgcttccgtgggctgggcgctgggttcgcggcgcgccctcctgctgcctccccggagctcccgggccagtagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgagttctttggcatttttgatcaatttcttcaagctgtgtcagaagccaaacaagaaaacgaaaatatgagaaagaaaacg

SEQ ID NO: 320707 - DNA, 6109 bp, Homo sapiens
agtaacctacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320708 - DNA, 6007 bp, Homo sapiens
agtaacctacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaagagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaaggaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320709 - DNA, 3473 bp, Homo sapiens
aaaatactgttgtctttctttgagatctgagcatggaagggaattttaaacatttaaattaaaataggatggacttccaagcgtgaaatatttaaacccatcttatatttaatatgtgtaagtcacatgttgattgctaaaacattgctatttacaacagcatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaacaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtacatatatgctttctatgaattattaaaacagtgtcatcaaactgctttgcagtttccaccattgaatttcaattttgcaaattgttcactgaatcggaaatatatacctgtttttaaacttgtacttactggacctagaagaatatagttttctattatggcagcattcagtatgttcaggttatcatatgccac

SEQ ID NO: 320710 - DNA, 1368 bp, Homo sapiens
cgcactcattcattaagtggcactgctcagtggtgcgggggtgggcgtgcttccgtgggctgggcgctgggttcgcggcgcgccctcctgctgcctccccggagctcccgggccagtagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttgtaagtgtgttcgtgactcacatgtgtgcttctgaatg

SEQ ID NO: 320711 - DNA, 279 bp, Homo sapiens
gtgcatccgctgtgctcagaaaaaggtgtctgaggcttattttcaaatagaaggaacaagaaaatgaaaggtaaagtcagaagggataagggaagacattacagaatttatcatcaagcaggaggttttttccaggttctaagatgaggttaagtttcttaacaaaagaatcaacaactgtcctttttttgttgggggagggtctcgacagaaaaaatgaatataccctcataagctgaaaatttgttttctgtattgttatttaactagataggcagc

SEQ ID NO: 320712 - DNA, 1515 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagaagtgattgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttgtcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 320713 - DNA, 489 bp, Homo sapiens
  misc_feature (379)..(379): n is a, c, g, or t
ctcacccggcccggacacggacaggattgacagattgatagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctgcctagcaaactcaaactacgaacgcactcacagtcgcatcataatcctctctcaaggacttcaaactctactcccactaatagctntttgatgacttctagcaagcctcgctaacctcgccttaccccccactattaacctactgggagaactctctgtgctagtccacgttctcctgatctatcactctcctctt

SEQ ID NO: 320714 - DNA, 1377 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttgtcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 320715 - DNA, 1202 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagaagtgattgagaggaacggacggaagctcaagctcttctacgggatgagctctgacaccgccatgaatggtggaatgctgtgtcctctcttctgtctcctgctgcctggaggcttcggggctctcccgcctgccttgtcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 320716 - DNA, 261 bp, Homo sapiens
aaagaagatggtttcactttaatataatgctattatcttaagacttaatggagttgctggagtttgtatttccaggagtcaagttgaatggtttgggatttgttttgctaccttcctagacaggctgatggcaagcctctcccggcgattagcagacaagtcaccttaggaggggcaaggagaggaggacagtgcgggggccaagggtggacaggccggagtcaaagtaactggcatccctcacctctagcttttggttgc

SEQ ID NO: 320717 - DNA, 793 bp, Homo sapiens
tagagacagagtttcaccatgttggccaggcttgtctcgaactcctgacctcaggtaatccacctgcctcggcctctcaaagtgctgggattacaggcatgagccaccacacttggctaatttttgtattcttagtagagatggggtttcaccatgttggccaggctggtctcaaactcctgacctcaggtgatctgcccgccttggcttcccaaagtgctaggattacagcatgagccaccgtgcctggccaaagtttagataatttaatgaatgaatcccctttacctctgctgttgcatgtgtcttgagcaggtgcactgtgcatttgattagggtagaccgaaaagggttgttgtactgtcccagaataggtgcataaatgggggcagggtctgatgtctgaatgctactgtttatgcctgtcttcttggtttattttggtgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggtaagtacggtagaacattacggtagaacattctcaagatggggaagccacgagggagttgttcaatgtgtcgggggagctgtatcctcttcagagcttttggtgcctctttagtcaaagattaattgaggatcatttgggaaaggataggtagccgctgcggaagatct

SEQ ID NO: 320718 - DNA, 950 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggaagaaaggatcaagaattgttccagctgggcgcagtggctcacgactgtaatcccagcactttgggaggccgaggcaggtggatcacctgaggtcaggaatttgagaccagcctggccaacatggcgaaaccgtgtctctactaaaaatacaaaaattagccagccgtgatggcgggtgcctgtaatcccagctacttaggaggctgaggcaggagaatctcttgaacccaggaggtgaagcttgcagtgagccgagatcacaccactgcactccagcctgggcaacagagggagactccgtctcaaaaaaaaaaaaagaattggccgggtgcagtggctaatgcctgtaatcccagcactttgggaggc

SEQ ID NO: 320719 - DNA, 1784 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagaagtgattgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttgtcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaaaaaaaaaaaaaaaaaaaaaaaaaaaaccggggggcattaatttgtcgcggggcggcggaaaaaaaagaggtgttcattgaaaaggggcgacacaggtggttcataggagtgggtttcccgaggcacccgcgtttctttgtacacagggggtaaaaattcggcgggacccccaatatgggggagcgagataaaattccgataaagcccgtggttaagccgcgctataagatctgtgggcaaacaggaacgacagcagcaggtgacgagaa

SEQ ID NO: 320720 - DNA, 1091 bp, Homo sapiens
ggctggcatgggatgagggctgagcccctctgccgctcacagcccctgctgcctcctgctctgcaacagaagtgtctgagcccaggcaggcaggtgggcagtgggtggtgccagcttctgacccacagaggaagcctggatgggcctggggagtgaaaggtgcaatattgaggggagtacactcgatcagacaacaacagccgtggtaggggaacttgggcccgtgggcttgctgggggctgtggtgggtctgaacccccagtcactaggtcatctggggggaggggacagcctggctgagctcccgctgatgatgtcctgtccttgctttttcctctgtgaaggatggaggctgtacgtgtccaggggatgtcgccaaagcctttggagctggagcagattttgtcatgctgggaggaatgttttcgggtcatacggagtgtgctggagaagtgattgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttgtcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 320721 - DNA, 1115 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagaagtgattgagaggaacggacggaagctcaagcttctcccgcctgccttgtcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 320722 - DNA, 1754 bp, Homo sapiens
tgttggaagtggagagtggagggtcagaagggagtggaccagttcaggtcccagagggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgc

SEQ ID NO: 320723 - DNA, 1655 bp, Homo sapiens
tgttggaagtggagagtggagggtcagaagggagtggaccagttcaggtcccagagggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgc

SEQ ID NO: 320724 - DNA, 1636 bp, Homo sapiens
gggactctcttgggcaaccgaggttccctgtgcactgtcaccatgggcctgtgtctctctcagcatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgc

SEQ ID NO: 320725 - DNA, 1787 bp, Homo sapiens
tgttggaagtggagagtggagggtcagaagggagtggaccagttcaggtcccagagggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccgtgagctcctggaaaccagtttagccgggccagaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgc

SEQ ID NO: 320726 - DNA, 1774 bp, Homo sapiens
tcaagggtgcagaggccaggcagagtgggtgcagagtgggggatgggcaaccagcctggtaacacctgggtgaggtgagcgagtcaagcccatctggaaatgctaaactcatcagctcagtacctaactgccaatcaacacactgccaatgcgggtgggctaagccgccaggatgcctgcagcagatggacgctgcccatccttgagccagccagctgggggcagagaggtgggtggcgggcacctcatgccagctgagaccaagagtggttgtatacatttctgcagcttgcagatttcatttttttggtcaccctttaagtgtccttctctcccaggatgagtgaggagctgtgctgatgttgggaacttatctttttccaggatccataacatttaggggaattatttgcgggctttcctagtgtattctaagaagttctaactctccatcaagaagcccaagattcctggagtctttttttcctctgccctgatcaactggggcccaggaaaagcaatgtctcttcacgggcctcagggccccagcagatggggctgggtcaggaaccatctctgtcccaggtgctcagccctcatatgcattttcttctggagcctcttagaatctcctccagaggactcatagagctgcctcccccaggatggtgaagttgggagcaaaatggggcttctgtaagtagaggtggaaaaccagagagatgtttccacagcagccatttccctaccctgtttcctaacttatgctgacaagttcttcctcttcctaccgtggggttcgagccccacttctggttgcatgttcccaccaccacgctctgctggttttagtcggctgacttttcaactgccccagcctctcctgctctctcagaacctccctctgcccccaccccccatctgtctcttcctcctaattaagggccactgcaaagagagacgggctggctaacccatgggatttagcttataagaacaaagcacaattattcaggactgaactgctttgaggtgccttggaactggctttggaaatagctatctgccccctagctatggactcttcacagttatttccagtttataaaaaggaaaagctgatcggatccatgtttctctctgcgagtctccttggggaggttgggctggtaaatatttgcaaggtcaggttaagcagacagacaattgaaaatactgggcaggtccaaaaggatagttccaggccataggaatggcttggtgcagttaacgggtgatgaagcaagaaatcttccttcctacttatgtcttaaagatggacagcctgtgtctcttgctgtgcctcttgctggcgtcttcctttattgaagcttgctgatgcactgtacatagtctctctctctaggtatagatatattatatatacaaatatcaaacatctcaccacacccaccccaaaagttacactgtgtgtgtgtggggaggtgtaataacttctcagtgttttgagttgattcaccaaaggcaaattttggaatgttcttgcgctttgtgcacttggaggggaaaacccaactacatatgcactttcttggttgtgtgtgctatagagaggttggaaggggtggttggaaggggagagaaactgagatggccctctgtgactcgactgctgggatgtatctgcttttgggagcagactgagtttcttttgcaatttgtcttattgtttgggtctactggcgacaataaactatctcccctgaaaatccct

SEQ ID NO: 320727 - DNA, 2119 bp, Homo sapiens
ggcacgaggaaagaaacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatgatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaatacaatggggggaaggatagcatttggagatatacctaatgttaaatgacgagttactggatgcagcacgccaacatggcacatgtatacatatgtagctaaccctgcgttgtgcacatgtaccctaaaacttaaagtataatttaaaaaaagcaaaaaaaaaaaataccaactcttttttttaaaccaggaaggaaaatgtgaacatggaaacaacttctagtattggatctgaaaataaagtgtcatccaagccataaaaaaaaa

SEQ ID NO: 320728 - DNA, 2142 bp, Homo sapiens
  misc_feature (2082)..(2082): n is a, c, g, or t
ggcacgaggaaagaaacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatgatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaataataatataaaaccttatgggcttatattgaaatttattattctaatccaaaagttaccccacacaaaagttactgagcttccttatgtttcacacattgtatttgaacacaaaacattaacaactccactcatagtatcaacattgttttgcaaatactcagaatattttggcttcattttgagcagaatttttgtttttaattttgccaatgaaatcttcaaatttnggaaaaataaactgagcaggccgttccctttaggagggtaattcatagcctcgctcctgt

SEQ ID NO: 320729 - DNA, 820 bp, Homo sapiens
  misc_feature (28)..(28): n is a, c, g, or t
  misc_feature (760)..(760): n is a, c, g, or t
gtcatatcgttaaccgactctcttaatnaaccaccgctacagctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaataataatataaaaccttatgggcttatattgaaatttattattctaatccaaaagttaccccacacaaaagttactgagcttccttatgtttcacacattgtatttgaacacaaaacattaacaactccactcatagtatcaacattgttttgcaaatactcagaatattttggcttcattttgagcagaatttttgtttttaattttgccaatgaaatcttcaaatttnggaaaaataaactgagcaggccgttccctttaggagggtaattcatagcctcgctcctgt

SEQ ID NO: 320730 - DNA, 595 bp, Homo sapiens
gaagatgcagccccttcctccagcctgagagaataaagcatcattggcttatgcaaccatggcaatcccattccccttttctcatgattgatttgggaatgggcaagtgacccagttctaaccaatgagacgaaagaaaaagtctgttggtcagcttatctcagaagatttttgtttcctgctataaagagaaacagtaagttccttcctgcctgacttaaatgcaattgtgtgcaaacatgttacttgggagctacagcaacgattctgtgaccatgaggcaataagccaaggacaaaggatagaatagtgaaaagacagagtattggattttttttatgatatcattgaactgctggacccaatgtggaaccatctacttttagtctttcatgatttgtgagatgattaaacatttcttttttttagccattatttcttttctgttacttgcaactgaagacatcctacataatacaaacactatccaacttggattgtaatttatctattttcagatctgtgtgttctgtcttactgatttttgtattcttagcactgagtataaggctgctacttagtaagacttcaataa

SEQ ID NO: 320731 - DNA, 405 bp, Homo sapiens
ctgtggaacagaattttaggggcttcatttatcttccaggtagaaaagagctgataaggggttatggagatgttgtcacctggcattatatgctataatccttggtcacatttataagtttttttattctaatacaatggatctgagtgtcattaggagccttgcagacaagtgtttctgggtaacttctcagtaacatctttgacatttgtttagttgcagacctaaatggccactgatggatactgcagtttcagtaagcagtggagtttatttccctggaagtagaatgaggcagacccagaatattgtagagtgcttgtcatcagctgtatttcttcatggcccagaaaaactcctatgtaacttcccttagagaaatgaaactgaacgggaagcagaagt

SEQ ID NO: 320732 - DNA, 694 bp, Homo sapiens
gccttaacaatagtcccactgaattatgttggttcaataaaggttggctattataatttttattattttcatgaacttaatagcttgttaatcttggttccacaggatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggtaattaattttgtgtttgatcattagcaaaattattgccactttatacagacatagtttgctctttgggtcccattctgttctgcagaacttgctctctccatggtcctcccttactttaatctggtggttctcaaccagggacagttttaccccctagaagacatttggtgatggctgcagatatttttgtcacaactgggaggaaagggtgctactggcatctagtgggtgaatgacagagatgctgctaaacatctcacagtgcacagggcagcctcccataaccaagagtgatccagccccaaatgacaacagtgttgaggctgggaaaccctgctctaatgcttcctttctattagattactacctctttcctccatgctgcatgcaactcttttgtctctttaaagctaaaacaaacca

SEQ ID NO: 320733 - DNA, 915 bp, Homo sapiens
tagaagcatttctactatatctcagcagtagagggaaaatgttaagtaaccgtatgtttatatgaaatatccatttgtatccatatttgagtgaatacttttttagatcctcctgaattagatcattagagctggctgttttttcccctcatgctttttgagaattcgcaggagtatcaactattatattcaaatgtcaatacagaagtatagctaaatgtagtttatcattttcctttttccaagccctctggctgcactaacatgagtgtttaaatttttgtagtcatgattttataatccgcaattgacatgtgaaagttagtgttccttttataatttcatctgatgttaaagtacggttaaaagtcttgctgttgatactaaacaggaaacaaaagcataacttaattctttccccttcttgttaagggtgaaacaaatgactttgagttgttgaagaaccagctgttagatccagacataaaggtaattaattttgtgtttgatcattagcaaaattattgccactttatacagacatagtttgctctttgggtcccattctgttctgcagaacttgctctctccatggtcctcccttactttaatctggtggttctcaaccagggacagttttaccccctagaagacatttggtgatggctgcagatatttttgtcacaactgggaggaaagggtgctactggcatctagtgggtgaatgacagagatgctgctaaacatctcacagtgcacagggcagcctcccataaccaagagtgatccagccccaaatgacaacagtgttgaggctgggaaaccctgctctaatgcttcctttctattagattactacctctttcctccatgctgcatgcaactcttttgtctctttaaagctaaaacaaacca

SEQ ID NO: 320734 - DNA, 1190 bp, Homo sapiens
gggacagaggctgtggctggaaggagctgggcatccggcctgaggcgcagcggtcgcgttagttcggcccaatggcggcaccgctgcttcacacgttgtttgtcgggagatgcggccgcttcgtcctctgcagtcaagacgctgggcgcgtcgaggactggcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatacaaaaattagccaggcgtggtggcaggatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgataatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttct

SEQ ID NO: 320735 - DNA, 369 bp, Homo sapiens
gtttgtgaccttttccccccaacctattcttgataaatgattgatataagatagctgtaaatttctgttatcttagaggatttgtgattttgaaagtactctttgtttaacttaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctcgtaagtcattactctttgcttgcttggaatttt

SEQ ID NO: 320736 - DNA, 1791 bp, Homo sapiens
ggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtaaaaaaaaaaaaaaaaaaaactcgactcgtgccgaattcggcacgaggcggtcgcgttagttcggcccaatggcggcaccgctgcttcacacgttgtttgtcgggagatgcggccgcttcgtcctctgcagtcaagacgctgggcgcgtcgaggactgggatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgataatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccacgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaaaaaaaa

SEQ ID NO: 320737 - DNA, 2163 bp, Homo sapiens
ggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtaaaaaaaaaaaaaaaaaaaactcgactcgtgccgaattcggcacgaggcggtcgcgttagttcggcccaatggcggcaccgctgcttcacacgttgtttgtcgggagatgcggccgcttcgtcctctgcagtcaagacgctgggcgcgtcgaggactggcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatacaaaaattagccaggcgtggtggcaggtgcctgtaatcccagctactcaggaggctgaggcaggagaattgcttgaacccggagatggaggttgcagttaagctgagatcacaccactgcactccagcctgggcagcagagcaagactccatctcaaaaaaaaaaaaaaatccagccacgtagagatttgggaaaagagtatttccaatagagtgaacgatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgataatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccacgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaaaaaaaa

SEQ ID NO: 320738 - DNA, 1456 bp, Homo sapiens
gccttaacaatagtcccactgaattatgttggttcaataaaggttggctattataatttttattattttcatgaacttaatagcttgttaatcttggttccacaggatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgataatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccacgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaaaaaaaa

SEQ ID NO: 320739 - DNA, 2154 bp, Homo sapiens
gggacagaggctgtggctggaaggagctgggcatccggcctgaggcgcagcggtcgcgttagttcggcccaatggcggcaccgctgcttcacacgttgtttgtcgggagatgcggccgcttcgtcctctgcagtcaagacgctgggcgcgtcgaggactgggtaagattcaggccgcttccttctgcgcgtctgggaccaaagctcaggaccgcgcttagaggagcggattgaaaggatgtgggacaaagctaatggcgtgtgataggagcacggggtcgagggtcatctcacgttcacagaaatgagctcattcctcctaactgggtaatagacatgggtggggcctggaaaagtgagtatgttctctgttctggaggcccactttcccgactgtgtctcttcgtgatttcccaggcctgggtactgccttctgcgccttgacccctcttccttccctcttcttcgtccaaatttggaagggatttccctgggctatgtgggttatcagccgaacgttgtcactcatggcaaattgaatattacatcttttttgtttgaaatttgtttcgacacacgtatttgtttcgcagtctttattttgctccacttttaaaatccctaacccccatagcactcttggcgtttaactttcagagtcattaggatgctatgttttttcattaatttactacgtgtaagtgaagcaaaccttgtaaaacaattagcgtaatatgattcctaatatttatcgagctcctgcttactgtgttaaacactggggacagtggtttatccaaagacactaatgtccctgctttctacagagcttacagcatagggtgggaaggcagtacacaggccaataaataaacgaacacgatgatttcagttatacaacaaggtaatgggggagggagaagggagagaaggagtgttcgagatttctcattgggaagacatctgtcatttcagcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatacaaaaattagccaggcgtggtggcaggtgcctgtaatcccagctactcaggaggctgaggcaggagaattgcttgaacccggagatggaggttgcagttaagctgagatcacaccactgcactccagcctgggcagcagagcaagactccatctcaaaaaaaaaaaaaaatccagccacgtagagatttgggaaaagagtatttccaatagagtgaacgatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgatagtaagtataaaaaggtttaaagcctgggcacagtggcttacacccataatcccagcattttgggaggccaagatgggaggatcacttgaggccaagagtttgagaccagcctgggcaacatagtgagaccttgtctctgcaaaaaaacattttttttcaaatattttcttaaaaaaggcttaaagtagaactaggcagggtagtgtgtgtctttagtcacagctacctgggaggcttaagtgggtggattgcttgagcccaggagttcaagctctgcctggtggcaagactctgtcttctttaaaaaaaaaaaagtaaagcacagaatacctggcatctattctaataagtagactgcaacaaat

SEQ ID NO: 320740 - DNA, 1261 bp, Homo sapiens
gtaatgacccctatggaggtgtctagattcatttgttgctgtgagtttgatgaattataacttgctttattgaactcctggtgaaatctaggaatttttagccatttaaaaactataaagttgcattactttttttcagattgtgcatttaattaatcattgggctaactttggattatggaaaaataactttttttatagctgttcattgtctaggtcaataactttttttgtatagccattcattgtctagatcaatgacagaacaacatattttctttttccctcaaaagcccgagtgatcattaaggaaggcgatgtagatgtttcagattctgatgatgaagatgataatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccacgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaaaaaaaa

SEQ ID NO: 320741 - DNA, 718 bp, Homo sapiens
gtaatgacccctatggaggtgtctagattcatttgttgctgtgagtttgatgaattataacttgctttattgaactcctggtgaaatctaggaatttttagccatttaaaaactataaagttgcattactttttttcagattgtgcatttaattaatcattgggctaactttggattatggaaaaataactttttttatagctgttcattgtctaggtcaataactttttttgtatagccattcattgtctagatcaatgacagaacaacatattttctttttccctcaaaagcccgagtgatcattaaggaaggcgatgtagatgtttcagattctgatgatgaagatgatagtaagtataaaaaggtttaaagcctgggcacagtggcttacacccataatcccagcattttgggaggccaagatgggaggatcacttgaggccaagagtttgagaccagcctgggcaacatagtgagaccttgtctctgcaaaaaaacattttttttcaaatattttcttaaaaaaggcttaaagtagaactaggcagggtagtgtgtgtctttagtcacagctacctgggaggcttaagtgggtggattgcttgagcccaggagttcaagctctgcctggtggcaagactctgtcttctttaaaaaaaaaaaagtaaagcacagaatacctggcatctattctaataagtagactgcaacaaat

SEQ ID NO: 320742 - DNA, 395 bp, Homo sapiens
aaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccagttctggccgggcgcggtggctcacacctgtaatcccagcactttggg

SEQ ID NO: 320743 - DNA, 2697 bp, Homo sapiens
gggacagaggctgtggctggaaggagctgggcatccggcctgaggcgcagcggtcgcgttagttcggcccaatggcggcaccgctgcttcacacgttgtttgtcgggagatgcggccgcttcgtcctctgcagtcaagacgctgggcgcgtcgaggactgggtaagattcaggccgcttccttctgcgcgtctgggaccaaagctcaggaccgcgcttagaggagcggattgaaaggatgtgggacaaagctaatggcgtgtgataggagcacggggtcgagggtcatctcacgttcacagaaatgagctcattcctcctaactgggtaatagacatgggtggggcctggaaaagtgagtatgttctctgttctggaggcccactttcccgactgtgtctcttcgtgatttcccaggcctgggtactgccttctgcgccttgacccctcttccttccctcttcttcgtccaaatttggaagggatttccctgggctatgtgggttatcagccgaacgttgtcactcatggcaaattgaatattacatcttttttgtttgaaatttgtttcgacacacgtatttgtttcgcagtctttattttgctccacttttaaaatccctaacccccatagcactcttggcgtttaactttcagagtcattaggatgctatgttttttcattaatttactacgtgtaagtgaagcaaaccttgtaaaacaattagcgtaatatgattcctaatatttatcgagctcctgcttactgtgttaaacactggggacagtggtttatccaaagacactaatgtccctgctttctacagagcttacagcatagggtgggaaggcagtacacaggccaataaataaacgaacacgatgatttcagttatacaacaaggtaatgggggagggagaagggagagaaggagtgttcgagatttctcattgggaagacatctgtcatttcagcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatacaaaaattagccaggcgtggtggcaggtgcctgtaatcccagctactcaggaggctgaggcaggagaattgcttgaacccggagatggaggttgcagttaagctgagatcacaccactgcactccagcctgggcagcagagcaagactccatctcaaaaaaaaaaaaaaatccagccacgtagagatttgggaaaagagtatttccaatagagtgaacgatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcatagactgttttcctcagaccgtgtctcagcatgattgcttcccattttgtgcctccccgagtgatcattaaggaaggcgatgtagatgtttcagattctgatgatgaagatgataatcttcctgcaaattttgacacatatcacagagccttgcaaataatagcaagatatgtaccatcatgagtatacttttccttattttgaatgtttaattctcaagaaaattgtaatcaattagtaaaaattataaaatgttaatagtattaaagcttgagtcttacattgcattttttttttttgtatccacttgaggaaacattacattctacaaaaagtggcatttccattttctatttattctctttaattgtttttcaaagttcgtatgcagattctcccccaattttgtatggtggttggaattttgtttttatcttcaacagatatgctatccaaaatttttcagtgagaaacccctgggtgtgtttgtgtcatgccatatgaataaaaattgcacttctaagaaaagcttttcaggtttgtgggtttcttttggaggggtggatttctagttccctctgtctgttgattatttgttaacttaaaaaaatccaacttgattattttttcttcttttaaaaataatatacatgtgtagtgggaaatgtcagcaaaagtgctgttatgtttctgtgggagagaagctccctctttgatttgctgttgatatcagagttaacagaagcttattttctctaagttgttatagactttctcagaagctatacattgtaagttccacgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaaaaaaaa

SEQ ID NO: 320744 - DNA, 1935 bp, Homo sapiens
gggacagaggctgtggctggaaggagctgggcatccggcctgaggcgcagcggtcgcgttagttcggcccaatggcggcaccgctgcttcacacgttgtttgtcgggagatgcggccgcttcgtcctctgcagtcaagacgctgggcgcgtcgaggactgggtaagattcaggccgcttccttctgcgcgtctgggaccaaagctcaggaccgcgcttagaggagcggattgaaaggatgtgggacaaagctaatggcgtgtgataggagcacggggtcgagggtcatctcacgttcacagaaatgagctcattcctcctaactgggtaatagacatgggtggggcctggaaaagtgagtatgttctctgttctggaggcccactttcccgactgtgtctcttcgtgatttcccaggcctgggtactgccttctgcgccttgacccctcttccttccctcttcttcgtccaaatttggaagggatttccctgggctatgtgggttatcagccgaacgttgtcactcatggcaaattgaatattacatcttttttgtttgaaatttgtttcgacacacgtatttgtttcgcagtctttattttgctccacttttaaaatccctaacccccatagcactcttggcgtttaactttcagagtcattaggatgctatgttttttcattaatttactacgtgtaagtgaagcaaaccttgtaaaacaattagcgtaatatgattcctaatatttatcgagctcctgcttactgtgttaaacactggggacagtggtttatccaaagacactaatgtccctgctttctacagagcttacagcatagggtgggaaggcagtacacaggccaataaataaacgaacacgatgatttcagttatacaacaaggtaatgggggagggagaagggagagaaggagtgttcgagatttctcattgggaagacatctgtcatttcagcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatacaaaaattagccaggcgtggtggcaggtgcctgtaatcccagctactcaggaggctgaggcaggagaattgcttgaacccggagatggaggttgcagttaagctgagatcacaccactgcactccagcctgggcagcagagcaagactccatctcaaaaaaaaaaaaaaatccagccacgtagagatttgggaaaagagtatttccaatagagtgaacgatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggtaattaattttgtgtttgatcattagcaaaattattgccactttatacagacatagtttgctctttgggtcccattctgttctgcagaacttgctctctccatggtcctcccttactttaatctggtggttctcaaccagggacagttttaccccctagaagacatttggtgatggctgcagatatttttgtcacaactgggaggaaagggtgctactggcatctagtgggtgaatgacagagatgctgctaaacatctcacagtgcacagggcagcctcccataaccaagagtgatccagccccaaatgacaacagtgttgaggctgggaaaccctgctctaatgcttcctttctattagattactacctctttcctccatgctgcatgcaactcttttgtctctttaaagctaaaacaaacca

SEQ ID NO: 320745 - DNA, 1341 bp, Homo sapiens
gggacagaggctgtggctggaaggagctgggcatccggcctgaggcgcagcggtcgcgttagttcggcccaatggcggcaccgctgcttcacacgttgtttgtcgggagatgcggccgcttcgtcctctgcagtcaagacgctgggcgcgtcgaggactgggtaagattcaggccgcttccttctgcgcgtctgggaccaaagctcaggaccgcgcttagaggagcggattgaaaggatgtgggacaaagctaatggcgtgtgataggagcacggggtcgagggtcatctcacgttcacagaaatgagctcattcctcctaactgggtaatagacatgggtggggcctggaaaagtgagtatgttctctgttctggaggcccactttcccgactgtgtctcttcgtgatttcccaggcctgggtactgccttctgcgccttgacccctcttccttccctcttcttcgtccaaatttggaagggatttccctgggctatgtgggttatcagccgaacgttgtcactcatggcaaattgaatattacatcttttttgtttgaaatttgtttcgacacacgtatttgtttcgcagtctttattttgctccacttttaaaatccctaacccccatagcactcttggcgtttaactttcagagtcattaggatgctatgttttttcattaatttactacgtgtaagtgaagcaaaccttgtaaaacaattagcgtaatatgattcctaatatttatcgagctcctgcttactgtgttaaacactggggacagtggtttatccaaagacactaatgtccctgctttctacagagcttacagcatagggtgggaaggcagtacacaggccaataaataaacgaacacgatgatttcagttatacaacaaggtaatgggggagggagaagggagagaaggagtgttcgagatttctcattgggaagacatctgtcatttcagcttctacttgaatgaagacaaaaatctaggccgggcgcggttgctcacgcctgtaatcccagcactttgggaggccgaggtgggcggatcactcctgacctcagatgatccacccaccttgacctcacttacaggcgtgagccaccgcgccttgtctctgttatatttatttctctatttaaattgatggatatatgcaaacctgatcattatcatacttatgccttgacacaagagaggcaataaactaatctaagtgatgcttgtgatgccaaagatgtcagaacactttctgggccaatggcagatacctcatgtcaccagatgctaagggtccacaataaaaagcgttgaatgaaaaaaaaaa

SEQ ID NO: 320746 - DNA, 543 bp, Homo sapiens
ctgggaggctgaggctgatggagagcgggcaggtagggtggagaggcaggaaggttggtggcagccacatggctgagggcctagagcctggccagggagtcgtggagagaggcagtgggtgggctgggggttcaggcctgcctgaaggggaggcagctggtgcagtggcccataccccatggggtgaaggcctgggcagggcccaggggcagcttcgagggtgacctggagctgctcaggaagtgagatggcccagcctgacctgaccattggctggcaaggaacgggatggagaagttgtgtcctgggccttcagcgagtgtgacattgtcattgttgggatagctttaaagatctgattgcttatgacatgccttgtagcgctaccagcatcttggcatttggcaggtctagtccagctcgctgtttgcacgtcttctgtcttattcctagaagagagagttcccagccttgcttgatttccccccattgatgggaggctcatcacttcatgggagactcattttacttaggccttctgag

SEQ ID NO: 320747 - DNA, 564 bp, Homo sapiens
  misc_feature (4)..(4): n is a, c, g, or t
tctnccagctgccggaccagcgggcctgccgcctctacggaccagtccctgctcaggtgtcacttttgctggcaggccgagattagggcaggagagtgggcaaggcgtcgcggccaggaggagaagggctctaccacgccaccctcctttggcctccgaacgcggaccccgcacacacacacccgcgcctctttggcaagcgtgccttgtcggctgggttaagccgcagtgcgtgcacaccgagcggcggggcgctgtggaacgcgggagcggactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagccactggccgggacagttgacacccatcttccttccctgctccttccagtcattctacacccaaggactggcaacgtggttggagcttttggggggaattatgaagaaatctgaataaatttctcacccttcaaaattc

SEQ ID NO: 320748 - DNA, 418 bp, Homo sapiens
cgttggcggcttaggggctgttactgtgtcccacccaggcgtgcacaccgagcggcggggcgctgtggaacgcgggagcggactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagccactggccgggacagttgacacccatcttccttccctgctccttccagtcattctacacccgcttggtgctgccagtgcgggcagggccttggagcccaaagcggatccccacacttgtccctacggtcggaaggaaagtagaggagagaaagtcaggcgcggcagggctaagagcaatagtgg

SEQ ID NO: 320749 - DNA, 796 bp, Homo sapiens
  misc_feature (4)..(4): n is a, c, g, or t
tctnccagctgccggaccagcgggcctgccgcctctacggaccagtccctgctcaggtgtcacttttgctggcaggccgagattagggcaggagagtgggcaaggcgtcgcggccaggaggagaagggctctaccacgccaccctcctttggcctccgaacgcggaccccgcacacacacacccgcgcctctttggcaagcgtgccttgtcggctgggttaagccgcagtgcgtgcacaccgagcggcggggcgctgtggaacgcgggagcggactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagccactggccgggacagttgacacccatcttccttccctgctccttccagtcattctacacccgcttggtgctgccagtgcgggcagggccttggagcccaaagcggatccccacacttgtccctacggtcggaaggaaagtagaggagagaaagtcaggcgcggcagggctaagagcaatagtggcccaaatgttcctggcccgcctgctgcgccacagagtctgaaaagcgggtctccgtctaccagaaggtgacctccacacagcccctctccccgaccaactgcagcacccaaggactggcaacgtggttggagcttttggggggaattatgaagaaatctgaataaatttctcacccttcaaaattc

SEQ ID NO: 320750 - DNA, 390 bp, Homo sapiens
  misc_feature (4)..(4): n is a, c, g, or t
tctnccagctgccggaccagcgggcctgccgcctctacggaccagtccctgctcaggcgtgcacaccgagcggcggggcgctgtggaacgcgggagcggactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagccactggccgggacagttgacacccatcttccttccctgctccttccagtcattctacacccaaggactggcaacgtggttggagcttttggggggaattatgaagaaatctgaataaatttctcacccttcaaaattc

SEQ ID NO: 320751 - DNA, 1921 bp, Homo sapiens
  misc_feature (1921)..(1921): n is a, c, g, or t
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgaggtaagcaggaatgtaaatggagttcaaggccttaacatttttgagcactgctactactgtcattaatatgtatctgaaaaatcttgtccaatttgaaatatattaaaatttccaaacttaaattgtatcaaatgatgaatgttttatctctgagacatagatttctaatttcactaattttacatgtattttcttgtgatatgctcatttgtctttagttatttatgttcttaggaaattattttcagatttttttagtgcacaataccttgtacacagtaggcatttaataaagggatataaaaatcctctcttttgtgcctacctgaaaagttaaaaaaaaaan

SEQ ID NO: 320752 - DNA, 7543 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320753 - DNA, 7496 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320754 - DNA, 7521 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaaggtttatttcacttttattttttaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320755 - DNA, 7119 bp, Homo sapiens
ctggtacggtcggaagtcctttggatggtcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320756 - DNA, 4568 bp, Homo sapiens
ctcctgtaaaatttataggattaaaagttttcatgtgcttgtgactaattatgaggtttatagtggtttacattttgagatagttatatatataatatgcccttttcttttgtgacattatacgtatttttttatattgcatttaaaattaaatgacttgcttttgccagattaaatacagataccattggggttttctgttttgattcctaatgataatatggattgatttcaggtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320757 - DNA, 3724 bp, Homo sapiens
tcgcctgaggatccccgtacagcagctatccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320758 - DNA, 3814 bp, Homo sapiens
tggtgaggctggtctcgaactcccgacctcaggtgatctgcccacctcagcctcccaaagtgctgggattacaggcgtgagccaccacgcatggcccagatttctattttgggattgtctatggtagggatatccaaaccttgccttactaaagaccacctgggtcacttgttaagaacctaaggactgtcagttttataaaataagacaacctatgtcttaagatgtctcagttccttttgtttgaaaaattgtacattaccagaagccataacttaaaactccaaggggcacctggtcctattctttggtataacagacactaggagtgatgtttatatctttcttcaagattagtttaggaggtttatttcacttttattttttaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320759 - DNA, 4193 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagggtagtgtaacagatttctatttttatttttatttttaaattttttttgagacagagttttcactcttgttgcccaggctgggagtgcagtggtgcagtctcggctcaccgcaacctctac

SEQ ID NO: 320760 - DNA, 4170 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagtggagataaattacactggtcagatgtctgtgaaatgtttgaatgcacttgtctgtcacagatcttaataagggtggatgttttatttgccagtgtct

SEQ ID NO: 320761 - DNA, 2930 bp, Homo sapiens
gagtatccccgcctctctaacattattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320762 - DNA, 3966 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagaaatttgcttaagattctgtaagtggtggtgcagatatatagtgcatggctataaatcactgtattcaaggaccatcatatatcttgcagtagcaacctaaaagatacgtgaataggtttacttttttcttattctcgttttataggtttacatgtactttgagcctcatgcttagatgataatataggtccaccattccacaaacctctgaaaagcagaatttttttcatgaaaacacagtaaacagtaaaacctaactt

SEQ ID NO: 320763 - DNA, 3689 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgagctacactaaattataccttgcgaataagtgttaacattggttatttataagtattgttacagtactttccagggcatatcattttgtttcaacttatgtgggggtgaggaaagcattgtaacaaaaatgttttttatattaagagatctacactgtatttagccaggtgccctcagacagatatccgaagcaggaatttggtctttggtctctgttttaagcaggatttgacttgtaaaatcaactcaaaattattcttgttaatggagtagtgctgatgcaaaactataataacttgtagtagactctaatgatgatcaaaactcttattttgtaatagttatccctagttttttgttttgttttgtttttttttttagatgaactcttgctctgttgcccagggtggagtgtagtagcatgatcccggttcactgagatctctgcctcctgggttcaagctatgcttctgcctcagcctcctgagtagctggaattacaggcacgtgccaccacgccca

SEQ ID NO: 320764 - DNA, 1011 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatccaagaatcaggattatgatgagttgcagattctccattctgaaaaacgtctcctgccacattcattctaccaggattaaaaggtcctactccagtcttggtctgtgaagttaaagatggggtgtatgttgg

SEQ ID NO: 320765 - DNA, 553 bp, Homo sapiens
tttgaagtcacgtaaagaaggtaatgtttttttaaaagccctctactccatctgtttaaacattatggaaaatttgttatcaaaaacagtcattacactagatcatagatttggaacaccaacaagtggtcataagaataaatgaatgtttgatgatttgtttccaaattaacgtgtgtagttgaagtttatttatgctgttgtagtttttaaactatgtttggagaaggaagtatgggtttatttaccttctttggtaaaggggatcacagggatagggtatgataacctttcattagggactaaaatcaggtcatgttactaactgtaattacgcagatgaatatagaagtaaaaaaaattaggaccaaagacaaaggatagagataaattatattttagcttgtttcatcttttgaggaagttattctaattttccatttttaacagggaaatgggcttgggggtgaagtgattgtcctatgcacacaagaagagagagagccagaattcagtgtgggtcagggaggagtgaaaaaaccccaaaccaaaa

SEQ ID NO: 320766 - DNA, 292 bp, Homo sapiens
acatgacaactcagaaaggacctgaaaacttacattatggtatgtaatgatttaggtgataacttgaaaaccctgtacatcagtctttacgtagttttgaatccaaagcactgataatgaatagttgattttggagatagcttaacagcaacttaaattccgtagattctctgggtcgaagtacccttgtatgttgtttttataaatgtattgcttttagttttattgtctttttgaaatttcatgctaattgagaaaaggcatagttgagagtgaggagaagctaaacagt

SEQ ID NO: 320767 - DNA, 477 bp, Homo sapiens
cagatatgtaccttttctttcctaggtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggcaaaaattattatacaaacaggattttgcagcgtttagaactaaatgagcggggtccactagagtca

SEQ ID NO: 320768 - DNA, 7473 bp, Homo sapiens
agcgggcgggggggcggggcctccccgggctcggccgcgccgccgcctcctccgcctcctcctcctcaccagcgctaaagccgggactggaccgagcggagttgaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320769 - DNA, 6211 bp, Homo sapiens
gttccaagagtgcttggaacaatagcagctcagtgggaaaaggatttaaaatcttcaaattcattcttcaccatactttttattattaaggcttatatttcatagctccatttaattgattttgtcaaatgacaaagaagtatgtcctcattataaacaaaaagcactgtgcctttcctaaatttttcaggttttacttaactctatgtagggattctgttaaactaaatataatagagagaaaaacattctgtttttgaaggcgacttagctgatgatcattgctttgtttggaccttagcagttgttgcatagttaatagtttgtatgtagatgaagactcatgactctaaacctgtttagagattaacaggattgtttgcagaggcaaaaagtgtaatgaaaaattggtaattcttttctagttaagttgtagtcttaaaaattatctttttatgtttcaaattttagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcagggtattacccaaaggttcaaacccgtgcataaagccatgcttcatgagttaattcatccaacaattctgctttattccaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320770 - DNA, 7235 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320771 - DNA, 5809 bp, Homo sapiens
atttgatttaacttgactatgacagagttctgcaaccactcagaggatcaaaacaacttgcacttgaagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcagggtattacccaaaggttcaaacccgtgcataaagccatgcttcatgagttaattcatccaacaattctgctttattccaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320772 - DNA, 5192 bp, Homo sapiens
ttgtctctagatgtatcccccgcaacgtgtgatttactcggcgttaagagaccgttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacaaaatttgga

SEQ ID NO: 320773 - DNA, 4540 bp, Homo sapiens
  misc_feature (4534)..(4534): n is a, c, g, or t
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttccataataaagatctagcagcatgactatctaatgggtcgacgcggcncgaact

SEQ ID NO: 320774 - DNA, 4064 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaaggtacattcacttaatagcctatataacaatatttctctataggcaaacaaggatacagtgttcttttagtgtgcctgagaatatgggaacatattttgttttctaggttggaaaataatttattttctatttatatagaatatagtaataatatattactgctatttattactactatttattactatttctatttgtatagaaatagtaattattactatttctagtaataatagtagtaataatttatttctagtaataatttattactgtttctaagtaataaaaatatctcagatttagttgatacctcaactaaacttgtattgatacaaggtcaaaatagaaaacagttgctaaagtagtaagttcaattatttgacaaaaatttagactgttttctagggagctgttttttccacgattatttctgatgagatgatcagtggggttgaagtacacagtttattatttctggtctcttttaggcataccaacacacatagaaagacatgctggacagtttgatcattcaggtagaccaaatctacatgcattaacaagtgtaattgttataatattctgtcaactttctgtgtttctgacttccaacataaagcaggttttaaaaataccttaagaaagatagctttcacaaattgtccccaaaagaaagaaaa

SEQ ID NO: 320775 - DNA, 2703 bp, Homo sapiens
agcgggcgggggggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccgcagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggcgagtaactcctttattacagcagctactttaaccagtcttaaaaaacgttgtagctgttaccattacaaatctggcaactcatttattttaaaaatgtacacacttaaggcccagccctgataatactattcattaaaattgtcttgtcatttcagc

SEQ ID NO: 320776 - DNA, 802 bp, Homo sapiens
ccagtaaaactccagcctgtggctgggcagggctttccctttggtcctttctctcataatatggtccctagagctcatgaagaatgtggactcccaggccctaccctggacctcttcattccaagtccgcccagcaacaaggtttccaggtgatttccatgcccttgaggtctgagctgaactgatttaaagcagccactctcagcgttgagctgcctcagtcagaggggcctggaggaccatactgctgattaggaggtctgggtggggcccaggaatcacatttcttacaagttcccaagcgatattgatgccgctgctgcaggggccaaactttgagaaccactggtctagaggccgcagccagcactctccaggcacactggcccctagaggcacgtgagtttgacatgcaaccccttgctgtcaaggtgtctttccagatgctgaccagggtctttccagaaccaacctgctctgtctcaatcagcctcgtgcccctggctttgaccttccaaatccttggctcccacaaaacctctgaacaggctgttggattcctactccaacttcttggttttgtaaccagggttcttggtcttctaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggtaagcagctcctcagcctccctctgggtgggtctggtggggagggag

SEQ ID NO: 320777 - DNA, 2261 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaata

SEQ ID NO: 320778 - DNA, 2217 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaataaaaaaaaaaaaagaaaaaaaaaaaaaaaaagaaaaaagggggggggcgcgaaaagagaccccccgcggagggggccccaaggaagtacacgacggaaccccgaggaatttcgtgggacaacaagaggcgtccgcccacaaagaggagagcgctcggataagaaaaaaacgagctgaaccgacccagtggccggaaggttaaaaccagacacggccctggtgacacgtggggaacaaaccggtggacatgcactgggggagaaccccctggtgaaagagacggggaacccacattcacaactgcggggggggggagcgagccacacattttgtggggcaaccactgcaacccgtaacacaagaaagtattcaaagggctccgaggagggggacgaccatacaggcgt

SEQ ID NO: 320779 - DNA, 2171 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaata

SEQ ID NO: 320780 - DNA, 1101 bp, Homo sapiens
aaaagagcttgggcttccctcccaggctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaata

SEQ ID NO: 320781 - DNA, 1345 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcagccaagcaccttgcaggtccccaggggcttgcctacggccacagagtaggaattccccttgtgggtcggcgcgaagacagactcgtggaacaatcttcaaatggagaaccagcttgtcccaggccttgggacggcaagcccaaggactattatcaatccatacgagcataattggtgtagcgaaaaaagaacaagcacaggtattataactgatggacaaacatcaccgtaacagaagaaggatacctgtgaagaaaccgcagtagcagcataatcacac

SEQ ID NO: 320782 - DNA, 274 bp, Homo sapiens
tcccttcccttaataccaagatgggggggtcaccttctagtgctagtcttccctgcagttgcttctcttttgccctggaatgccgggtggagaccctgctactccttgtgcgagagggcagaccccgttttcttcccgcctctccagactgtcctctagggagcgtggggagagcccgggtttacgtgggtccctgtgctggcaggcttacatcctgagcatggagccctgtggccactgcctcattatcaacaatgtgaacttctgccgtgag

SEQ ID NO: 320783 - DNA, 361 bp, Homo sapiens
cctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaata

SEQ ID NO: 320784 - DNA, 1811 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaata

SEQ ID NO: 320785 - DNA, 1827 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatatgaataacctctctatatctgagcatatgccgtgcctgttgggtgatgtggt

SEQ ID NO: 320786 - DNA, 2081 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaata

SEQ ID NO: 320787 - DNA, 1122 bp, Homo sapiens
gacgcagtggtggattctggagcggggcggtgacgtggggcgggttctggggcggggcggtgacgcggagcgtgttctggggcggcgcggtgatgggaggcttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaggggctggcttttggattgttgaggtgtatatctgggagcagagatcatgaatagctcagggcagtgaatggcgcaccacgagcagggctgtgtgtgggagctgcagccaggattgcctcagctccgtcccccttgtccagactt

SEQ ID NO: 320788 - DNA, 689 bp, Homo sapiens
gccaaagagagagagagagggagtttgagaatccaggcagaaatgtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatgg

SEQ ID NO: 320789 - DNA, 2212 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatgg

SEQ ID NO: 320790 - DNA, 580 bp, Homo sapiens
ggtactttgcgggcaacctggcctccggcggtgcggcggcgcgactccctctgcttcgtgtacccgctggatttcgccagaacccgcctggcagcggacgtgggaaagtcaggcacagagcgcgagttccgaggcctgggagactgcctggtgcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatgg

SEQ ID NO: 320791 - DNA, 482 bp, Homo sapiens
gtacggctgtaaatagcctctctgtgttggatccatgttatatctaagaaggcttgtttcttaataccctctcatatagtttgggggggttccccaccctcaactcacccacccaggaaaccagactatgcaacttgtgtgtgccatttggagtgtccttatgtttgtctcaggaagcccgtggcattccccaaagccctaagaaagagctcacgttcatgcaatttcagatttataaaacaggtcaaatgatttccctgaaatcacttacaccttctacttcttgtgttttcttttgtgtcctcaccttgggcttacaggtatctctggagacaaagtagagatagaccctgttacgaatcagaaagccagcactaagttttggattaagcagaaacccatctcaatcgattccgacctgctctgtgcctgtgaccttgctgaagagaaaagccccagtgagtagtcccttttatttatgt

SEQ ID NO: 320792 - DNA, 281 bp, Homo sapiens
gactttaacactttactaaggctttatcagcttttcaccagtatgtggtgttttttaaatgttaaattcgctgtttcagacttcctcccctcctcctgcccctttgatcttccaggccctcagtaccgcctggagaagcagagcgagcccaatgtcgccgttgacctggacagcactttggagagccagagcgcatgggagttctgcctggtccgcgagaacagtacgttgcccctcgctccatgcccgcttgtcctatatactaggcgggtccaggctca

SEQ ID NO: 320793 - DNA, 3389 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320794 - DNA, 3722 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaataccaaaaaaaaaaaaaaaaaaaaaaacccttttgcggcgcgcgcctgggccccggaaaaagctcttccagaaacccatccgttgggcggcagcgagcgcccattagcggtaagtgtgagacactgtgcgccatagcgctggttccccaaggagaaaacccggggccaggagacatagggcgcctggggattttctcccccatttaaaaaagacgccgcggggggaacacgcaagggtttctgaacccaatttcccaatatgggagtcccgggaggtcactacagcggtttctaatcaacggggagttcccagggcaagctgaatttccatagccc

SEQ ID NO: 320795 - DNA, 3362 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcataaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320796 - DNA, 3061 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320797 - DNA, 3577 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagggttcttgctctattgaccaggctggagtgcagtggcacgatcacggctcactgcagcctcaacttcctggactcaagcgatcctcccacctcttcctccccagcagctgggactacaggcatgcactaccacggcctcccaaattgttgggattgtaagcatgaaccactgcatctggccaggcctggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320798 - DNA, 3218 bp, Homo sapiens
aattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaacccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320799 - DNA, 2614 bp, Homo sapiens
gctaggtacgaggctcggtgttattttacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320800 - DNA, 2319 bp, Homo sapiens
  misc_feature (38)..(38): n is a, c, g, or t
  misc_feature (46)..(47): n is a, c, g, or t
  misc_feature (55)..(55): n is a, c, g, or t
agggggagggggcgaagggcggagggggcgggaaacgntacggagnngtgcggtncaccttaccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagacccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320801 - DNA, 2051 bp, Homo sapiens
gacaccatttgccaagcctcatgtatctttatgtgttaaactgccttttcctccccaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320802 - DNA, 2172 bp, Homo sapiens
gtacggctgtaaatagcctctctgtgttggatccatgttatatctaagaaggcttgtttcttaataccctctcatatagtttgggggggttccccaccctcaactcacccacccaggaaaccagactatgcaacttgtgtgtgccatttggagtgtccttatgtttgtctcaggaagcccgtggcattccccaaagccctaagaaagagctcacgttcatgcaatttcagatttataaaacaggtcaaatgatttccctgaaatcacttacaccttctacttcttgtgttttcttttgtgtcctcaccttgggcttacaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320803 - DNA, 1758 bp, Homo sapiens
gccaaagagagagagagagggagtttgagaatccaggcagaaatgtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320804 - DNA, 575 bp, Homo sapiens
  misc_feature (137)..(137): n is a, c, g, or t
  misc_feature (208)..(208): n is a, c, g, or t
  misc_feature (214)..(214): n is a, c, g, or t
  misc_feature (221)..(221): n is a, c, g, or t
ggggggggggggggggggggggggggggggggggggggggggggggggggggggggggggggggggggggggggggggggggggggggggggggggggggggggggggggggggggggggggggggggggggggggnggggggggggggggggggggggggggggggggggggggggggggggggggggggggggggggggggggggnggattnggttttnggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320805 - DNA, 908 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagattaggaagacccataataaattacacagctggtaggagacagagccaggattcaaacccaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaaggtaagtaaaaatgagact

SEQ ID NO: 320806 - DNA, 492 bp, Homo sapiens
  misc_feature (232)..(232): n is a, c, g, or t
  misc_feature (261)..(261): n is a, c, g, or t
  misc_feature (321)..(321): n is a, c, g, or t
  misc_feature (325)..(325): n is a, c, g, or t
  misc_feature (332)..(332): n is a, c, g, or t
  misc_feature (360)..(360): n is a, c, g, or t
  misc_feature (487)..(487): n is a, c, g, or t
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtccccccccccnccccccccccccccctccccccccccccntccccccccccttccccccccccccccccccccccccccccccccccccccccccccccncccnccccccntccccccccccccccccccccccccccnccccccccccccccccccccccccccccccccccccccccccccccccccccccccccccccccccccccccccccccccccccccccccttccccttccccccccccccccccccccccccccccncccaa

SEQ ID NO: 320807 - DNA, 3209 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320808 - DNA, 3305 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatgctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320809 - DNA, 2971 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320810 - DNA, 2900 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagcccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaagggcccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatac

SEQ ID NO: 320811 - DNA, 1591 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggtgcttgtgactaaattcactaatttcactggctgtcaaggctgtgttaaggaaaatgggtttgaactgctgtgggttttgagtactggactggatgtcagaaacctttgccatcacgggaaattctgtcactctggatttactgtctgttccccacagctaaattcctctgcagtgtgatttagcaccctggatccccatcaaccagttttggcatttatttgaatgcattaccccactggtttccataaactattttacaattgtttaaaataaatgactgtttatttccacaaaaccatc

SEQ ID NO: 320812 - DNA, 648 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaatccagcagcccaggagtcgacgcg

SEQ ID NO: 320813 - DNA, 119 bp, Homo sapiens
aaaataaggtgctccctaccagacatgaaaatatatatcattagtctagaataaaataaatggtgtagcactggaacaagaatattcaaatgaggaaatcagaatccaaagcccagacc

SEQ ID NO: 320814 - DNA, 2433 bp, Homo sapiens
  misc_feature (2433)..(2433): n is a, c, g, or t
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320815 - DNA, 2550 bp, Homo sapiens
  misc_feature (2550)..(2550): n is a, c, g, or t
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttggctcggtgactcggcccggcaaccatgccagggctgaactagctgacacagggggaggagccccgaagtggaagagagagagcctcctttcactttccctacccctcaggacacacaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320816 - DNA, 2632 bp, Homo sapiens
  misc_feature (2632)..(2632): n is a, c, g, or t
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtgagatggccaaggaaggtgggcaggccctggactgagggaggggactcgttggagagttcccgctggttgggctctgccactgcccagctgcgcagcctcagccacagaactcccctctggcctcaggctggctggtctctgtctggtgtcacgccctgccccgctgctcctgcccacatgtgccctctatcttcaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320817 - DNA, 2261 bp, Homo sapiens
  misc_feature (2261)..(2261): n is a, c, g, or t
ctgagagtgggtcgttggggatgaggagaccatggaggcctaagggcctctctgtgccccaggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtgagatggccaaggaaggtgggcaggccctggactgagggaggggactcgttggagagttcccgctggttgggctctgccactgcccagctgcgcagcctcagccacagaactcccctctggcctcaggctggctggtctctgtctggtgtcacgccctgccccgctgctcctgcccacatgtgccctctatcttcaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320818 - DNA, 2099 bp, Homo sapiens
  misc_feature (2099)..(2099): n is a, c, g, or t
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320819 - DNA, 1422 bp, Homo sapiens
  misc_feature (1422)..(1422): n is a, c, g, or t
ggacgcgtgggtcgaccacgcgtcggagatgtgcgaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320820 - DNA, 627 bp, Homo sapiens
cgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggtgagtgtcctatggtcctgcccacggcagggcagggcaaggcctggtgggactggcctttgccctctatcagttcaaggccactgatccggagttctggctcctcagaactcttgagtccattgggaagggcttctacagctctgggttctaagctccgggaggataatctggccccaagaatcctgcccccaggatcctctgcccaccctcccccatagctcggtgactcggcccggcaaccatgccagggctgaactagctgacacagggggaggagccc

SEQ ID NO: 320821 - DNA, 832 bp, Homo sapiens
  misc_feature (832)..(832): n is a, c, g, or t
ccttttcttgctggagcagcaaagccagaaggaataacatcgcagcagagaggggccccacaggtcagcaggaggcaggctgagctgcccaccggtgcctccctgtgtcttgcagttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320822 - DNA, 2164 bp, Homo sapiens
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactat

SEQ ID NO: 320823 - DNA, 2520 bp, Homo sapiens
  misc_feature (2520)..(2520): n is a, c, g, or t
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctgggtgaggggtgagaggcaggcagggtggcaggggcctcagggtggcagggctgtggggctgagtctccccactcccctgtccccctagatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgacaagatttcctcctaaaaaaaggcn

SEQ ID NO: 320824 - DNA, 2421 bp, Homo sapiens
ctccatgggcagcccggcgctagacccaacggggatccaagcagccccggggagagggaggctgcgtctgtatccgggcccaaggtcaccgcgcgaccggcagatgcgtgctgcaggccccggccacatgagcagcgctacggacgcgactgccccggccttggatatgccagatcgagtgtccacccgtccgtgggactggtcgcctgactcggcctgccccagcctctgcttcaccccactggtggccaaatagccgatgtctaatcccccacacaagctcatccccggcctctggcgattgttgggaattctctccctaattcacgcctgaggctcatggagagttgctagacctgggactgccctgggaggcgcacacaaccaggccgggtggcagccaggacctctcccatgtccctgcttttcttgggacagccatggctccaaagccgaagccctgggtacagactgagggccctgagaagaagaagggccggcaggcaggaagggaggaggaccccttccgctccaccgctgaggccctcaaggccatacccgcagagaagcgcataatccgcgtggatccaacatgtccactcagcagcaaccccgggacccaggtgtatgaggactacaactgcaccctgaaccagaccaacatcgagaacaacaacaacaagttctacatcatccagctgctccaagacagcaaccgcttcttcacctgctggaaccgctggggccgtgtgggagaggtcggccagtcaaagatcaaccacttcacaaggctagaagatgcaaagaaggactttgagaagaaatttcgggaaaagaccaagaacaactgggcagagcgggaccactttgtgtctcacccgggcaagtacacacttatcgaagtacaggcagaggatgaggcccaggaagctgtggtgaaggtggacagaggcccagtgaggactgtgactaagcgggtgcagccctgctccctggacccagccacgcagaagctcatcactaacatcttcagcaaggagatgttcaagaacaccatggccctcatggacctggatgtgaagaagatgcccctgggaaagctgagcaagcaacagattgcacggggtttcgaggccttggaggcgctggaggaggccctgaaaggccccacggatggtggccaaagcctggaggagctgtcctcacacttttacaccgtcatcccgcacaacttcggccacagccagcccccgcccatcaattcccctgagcttctgcaggccaagaaggacatgctgctggtgctggcggacatcgagctggcccaggccctgcaggcagtctctgagcaggagaagacggtggaggaggtgccacaccccctggaccgagactaccagcttctcaagtgccagctgcagctgctagactctggagcacctgagtacaaggtgatacagacctacttagaacagactggcagcaaccacaggtgccctacacttcaacacatctggaaagtaaaccaagaaggggaggaagacagattccaggcccactccaaactgggtaatcggaagctgctgtggcatggcaccaacatggccgtggtggccgccatcctcactagtgggctccgcatcatgccacattctggtgggcgtgttggcaagggcatctactttgcctcagagaacagcaagtcagctggatatgttattggcatgaagtgtggggcccaccatgtcggctacatgttcctgggtgaggtggccctgggcagagagcaccatatcaacacggacaaccccagcttgaagagcccacctcctggcttcgacagtgtcattgcccgaggccacaccgagcctgatccgacccaggacactgagttggagctggatggccagcaagtggtggtgccccagggccagcctgtgccctgcccagagttcagcagctccacattctcccagagcgagtacctcatctaccaggagagccagtgtcgcctgcgctacctgctggaggtccacctctgagtgcccgccctgtcccccggggtcctgcaaggctggactgtgatcttcaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcacacaggcacagggggagcatacagtgggatggggatcctca

SEQ ID NO: 320825 - DNA, 535 bp, Homo sapiens
cttccccaccggagggggcggctggcgcgcacggagggcggtgagtggccggggacctggcgtccgagaaggggaatggaggaggaggcagcggcggatgtcatctggctatgggcggagcaggtgatggagaaggggagcatgaccccgggggtgggaatcccacggatgggaagttgaatccgacaggcaccccggaactgactcgtgggggtgtttcctgggcaggaggactcgaaggggtggagagaggcaggccagggcaaaggtgggccgctgggctgagaggaagctctagtgagaacaggtgatagaggcagaacttctaagttgggagagtggagcggccgccgcttggctctgggacagggagcgcagggagagttggtgaggtgggcagaggcccgggagtgaggggaggaaaactgcgggggtagagtccacgaaccttggaggggagtcactggtgaagaggttggaagaggagcctgaagaacctgtttccttttccttctggaaaaggaattcgttggtg

SEQ ID NO: 320826 - DNA, 4108 bp, Homo sapiens
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320827 - DNA, 4056 bp, Homo sapiens
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320828 - DNA, 4004 bp, Homo sapiens
cttccccaccggagggggcggctggcgcgcacggagggcggtgagtggccggggacctggcgtccgagaaggggaatggaggaggaggcagcggcggatgtcatctggctatgggcggagcaggtgatggagaaggggagcatgaccccgggggtgggaatcccacggatgggaagttgaatccgacaggcaccccggaactgactcgtgggggtgtttcctgggcaggaggactcgaaggggtggagagaggcaggccagggcaaaggtgggccgctgggctgagaggaagctctagtgagaacaggtgatagaggcagaacttctaagttgggagagtggagcggccgccgcttggctctgggacagggagcgcagggagagttggtgagggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320829 - DNA, 2355 bp, Homo sapiens
  misc_feature (2327)..(2327): n is a, c, g, or t
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacactataacaacctacngaagtgctattattgaatttacattatt

SEQ ID NO: 320830 - DNA, 753 bp, Homo sapiens
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcagcccttaatatggactttgacagcaccaataatagcatcccgcatccaaacaattgactctacccaggctctgttccttccaattggagcatctgtctctcttttagtaatgttcttcttctttgactcagttcaagtagtttttacaatatgtacagcaggtaaatatgagtttctctg

SEQ ID NO: 320831 - DNA, 3409 bp, Homo sapiens
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacata

SEQ ID NO: 320832 - DNA, 3666 bp, Homo sapiens
aagaatagaaaactcagtggtcaagaaatggggaaaatgaaaatgttttactagggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320833 - DNA, 3684 bp, Homo sapiens
agtggagcagccgccgcagctgcgcggccgccgcttggctctgggacagggagcgcagggagagttggtgagggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320834 - DNA, 4084 bp, Homo sapiens
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320835 - DNA, 3170 bp, Homo sapiens
caaagattttctcaaatcatacagtcaacgaaagcattgcagtcacagcattctgagactctgctcttaagagcaaggagggctgatgctgaaagcaggttgcttccaactccctctgttaaaggcatctctccaactcggcaggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaagggggcgtcaaaatttccccggagggccaagttaagagttacacattctgtaaaaggggcctatagggggatataaagc

SEQ ID NO: 320836 - DNA, 2767 bp, Homo sapiens
  misc_feature (2476)..(2476): n is a, c, g, or t
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtttttttttatccttggggggggataagctgctgtccttccccttcancaaatgtgggaaacccccccccggggcccagaagggtttttttaaaacccccaaaaaaacaccaaacccccttttttctacacacgcggggggcctttttttgacaaccgtttttcttttcaaccaacggggggggcggccccccgagacaaaaaagtgtcttttttttttggatagtcaggcgtagcaggggggggggcgagcactttattgtgcggggggcgacgcctccactcgatgctctctatgttgggggggggggcacaacacacagcgagttgtcttactgtg

SEQ ID NO: 320837 - DNA, 2163 bp, Homo sapiens
atcgagtggcctcgcctcatcgcctagcgcccccctcagtcgccgccgcctccgcccgctggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctccagcggagccgccgccgccgccgcgggtgagggaggccgagagcggagcccgccccgccccggggcccagggagcggggccgcctcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcattgaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctatgggggactcagtttcagagaactgagacagaagctcttctgtcgttatattcttctttcctttttttggatttattaaatattttctgtggtgtga

SEQ ID NO: 320838 - DNA, 501 bp, Homo sapiens
cttaggggaatgtgttttcttatgaaattttaatgtgatgacaaatgctgattgcccagcagcacattttctgtttctgtcttcgggaaaataggttaattttaagcagtgcgaaggggagctcaggccagtgttttcactccccgtgtgtcgttgatgtctctctcccacagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtataatattaaatatgacactgcttttcttttttttttttttaagtaacattttaaacgtgatattcacgtagcataaaagtcaccatttcaaaatatacaattagtgg

SEQ ID NO: 320839 - DNA, 4752 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320840 - DNA, 4699 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaaccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320841 - DNA, 3518 bp, Homo sapiens
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagagggagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320842 - DNA, 3832 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320843 - DNA, 4764 bp, Homo sapiens
  misc_feature (2799)..(2799): n is a, c, g, or t
  misc_feature (4031)..(4031): n is a, c, g, or t
  misc_feature (4052)..(4052): n is a, c, g, or t
  misc_feature (4068)..(4068): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagccggaaatcagtatgagtaagcgttctggattgtgcaggcaatacattttcgttagaaatgtggagttatttttccattgcacggttttacaacggattggggaacggaaatatctgtcgtacanggcctggctgtgaaaatgaanaatatgcgtatcctgntgcagtagacaatagactacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320844 - DNA, 4407 bp, Homo sapiens
  misc_feature (2454)..(2454): n is a, c, g, or t
cttaggggaatgtgttttcttatgaaattttaatgtgatgacaaatgctgattgcccagcagcacattttctgtttctgtcttcgggaaaataggttaattttaagcagtgcgaaggggagctcaggccagtgttttcactccccgtgtgtcgttgatgtctctctcccacagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320845 - DNA, 5075 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaaaaaaaaataatcgtccgctcaacgccgacaccagaccgaccaccaccgaccaccacaacacgtacatagcgtccacaacgacgcccgaacagagagagtcgaatgaaccctagagccgccttcgaccgaccatgaggcgagacatatcgccgtgccgccagctcccgcatcgtatgtcgactgggtggacccagcgccgactccgccaaccgcggccgacggacagcctaggcgggggcgagcccgcacaatccccccaccgggactcgggacaggatccgtccgggcggcgggggaatgcgagcctggccgtacggacgccg

SEQ ID NO: 320846 - DNA, 5940 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaaccacagtgtgattgtctgggatgtgaaactctgaggtcactcttgggtaagaagcgtcttaagcctttagcctcaaacgacgtgtgtttggcctcctcaatttctttctgaattcctacctctaaccagttgtaatgataattccttttgccctgcaggccaccacataggtttgtaaggccttggaacaggagcctcagtgcccctgaagtagcaggtgcagggacagtggacgtcaatgtgagtgatgtgttatgtgttgaatgtgctgccatgttagcacgtagacccatttgctgttaatcactgaatcaagctgaatatttgcttaaatgtgactatctgggcatcattttgccacaaaaacttgtaaaattttacgtcacgtgggttactttttaaaaagcatttattaagctcctctaaatgaaaaggatactgtggagaaatggaaaactgctgggaaaaaactactagaaaaaaggttgctgccacccagtgccttgctatcaacggaagtcggactcaggagggctgcaggagtttgggaaagcagcgaagttgtaactgagaccatctgccacataagctggccaggtgctaacccctggctttaggagctctgcccttgctggaaagggagagaagctggagcaaacgttcctcatccttccatgagtcactgctcagattactgtgtggaacttcccagtagcaccaggttaacagtgggactgttattccggaggaactggattcctttgcaatagggcaggtgccactcagtggtggagtcttgttacctaaaaccggcacaccctgacataccacactctgcccagcacagggcctggcacaccgacgctcggtgcgtaggtgtggaactagcgagggatttcttgctggattgtcactccctgatgttttccatgtggactgggagtcatcccaagctactgtgacaaggacgaagacttcatgccatgcaaacacggggaaaatcaaaactgcccaagccaaaggatctgaaattatggcctgtcagagcttctgggttttactcttgacaaatgattaccttttaaagaaataaccggccgggcacagtggcttacccctgtaatcccagcattttatgagccggcccccgacggctcatccgctgcctgagccccagcgaaggaaggc

SEQ ID NO: 320847 - DNA, 3559 bp, Homo sapiens
  misc_feature (1606)..(1606): n is a, c, g, or t
gcagctgccagaacatctcaccaatttcaaatctggtaagtggcctcttatttactctcttctccagcttccctcactatccctcaacctctttctcctttcaatcttggcgccacacttcaatctctcccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320848 - DNA, 5788 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaaccacagtgtgattgtctgggatgtgaaactctgaggtcactcttgggtaagaagcgtcttaagcctttagcctcaaacgacgtgtgtttggcctcctcaatttctttctgaattcctacctctaaccagttgtaatgataattccttttgccctgcaggccaccacataggtttgtaaggccttggaacaggagcctcagtgcccctgaagtagcaggtgcagggacagtggacgtcaatgtgagtgatgtgttatgtgttgaatgtgctgccatgttagcacgtagacccatttgctgttaatcactgaatcaagctgaatatttgcttaaatgtgactatctgggcatcattttgccacaaaaacttgtaaaattttacgtcacgtgggttactttttaaaaagcatttattaagctcctctaaatgaaaaggatactgtggagaaatggaaaactgctgggaaaaaactactagaaaaaaggttgctgccacccagtgccttgctatcaacggaagtcggactcaggagggctgcaggagtttgggaaagcagcgaagttgtaactgagaccatctgccacataagctggccaggtgctaacccctggctttaggagctctgcccttgctggaaagggagagaagctggagcaaacgttcctcatccttccatgagtcactgctcagattactgtgtggaacttcccagtagcaccaggttaacagtgggactgttattccggaggaatggattgtcactccctgatgttttccatgtggactgggagtcatcccaagctactgtgacaaggacgaagacttcatgccatgcaaacacggggaaaatcaaaactgcccaagccaaaggatctgaaattatggcctgtcagagcttctgggttttactcttgacaaatgattaccttttaaagaaataaccggccgggcacagtggcttacccctgtaatcccagcattttatgagccggcccccgacggctcatccgctgcctgagccccagcgaaggaaggc

SEQ ID NO: 320849 - DNA, 3214 bp, Homo sapiens
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggaggagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320850 - DNA, 3394 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320851 - DNA, 1437 bp, Homo sapiens
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320852 - DNA, 742 bp, Homo sapiens
ctggagcaaacgttcctcatccttccatgagtcactgctcagattactgtgtggaacttcccagtagcaccaggttaacagtgggactgttattccggaggaactggattcctttgcaatagggcaggtgccactcagtggtggagtcttgttacctaaaaccggcacaccctgacataccacactctgcccagcacagggcctggcacaccgacgctcggtgcgtaggtgtggaactagcgagggatttcttgctggattgtcactccctgatgttttccatgtggactgggagtcatcccaagctactgtgacaaggacgaagacttcatgccatgcaaacacggggaaaatcaaaactgcccaagccaaaggatctgaaattatggcctgtcagagcttctgggttttactcttgacaaatgattaccttttaaagaaataaccggccgggcacagtggcttacccctgtaatcccagcattttgggaggccgaggtgggcggatcacctgaggttgggagttcgaggccagcctgaccaacatggagaaaccccctctctacttaaaatacaaaaaattagccgggtgtgatggtacatgcctgtaatcccagctactctgggggctgaggtaggagaatcgcttgaacctgggaggcggaggttgcggtgagccagagattgcgccattgcactccagcctgggcaacaaagagtgaaattctgtcttaaaaacaac

SEQ ID NO: 320853 - DNA, 699 bp, Homo sapiens
tctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctg

SEQ ID NO: 320854 - DNA, 3594 bp, Homo sapiens
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320855 - DNA, 3557 bp, Homo sapiens
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320856 - DNA, 4859 bp, Homo sapiens
  misc_feature (2906)..(2906): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtcacatctagtgcatccccacagccactgtaggatttttccctacactatgatttcagtcccttgagccttctagtctgacctggatatgaaccagtggcttcaaggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320857 - DNA, 4582 bp, Homo sapiens
  misc_feature (2629)..(2629): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctgaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320858 - DNA, 4698 bp, Homo sapiens
  misc_feature (2745)..(2745): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320859 - DNA, 4551 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaaaaaaaaaaaacacaacacaaaaaaacccttgtgtggggccggcctgggcccaagaaaaagtcttcaaacaccctctcgtgggggcgcgcgggcccaagaggtaaggacacctggccaaccgcgggcccaaagggaaccgggccggacacgcgctgggtcccaccattaaaaacgggggcgaccccgggcttctggacgaccgaggcgtcggacgcctacggtcccacaggggccacgggcgatatcgcggcagagg

SEQ ID NO: 320860 - DNA, 4669 bp, Homo sapiens
  misc_feature (2799)..(2799): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggccctataccaccatcccggttggcaatcttgttgttgatgaggttgttcagggcgaccacggaacggatcagcgagccaagtacactaccaccatctggtcattggtcttcaggtaaaaggccttgacgaactcctgcaggctgacatctggcagcaggttgaagacgtcctgcagctggtagatgatctggtgtatca

SEQ ID NO: 320861 - DNA, 3664 bp, Homo sapiens
  misc_feature (1711)..(1711): n is a, c, g, or t
gcagccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccnggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaatgatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaaattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattgcaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 320862 - DNA, 390 bp, Homo sapiens
tacacctccgttgacgtctgcttcgttgcatttgagggaaatgttggcatcgatttgacttaaaccttctccccagagtgatttcctccctttcctttgtcaacagaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320863 - DNA, 1132 bp, Homo sapiens
gtacagaactttatgtgaagttgtgaatatcctttataccagaggtttttcaaaaaagttgacaacgccccctcattcattgagatgctgtttcccaagtaggctcccgggcttgtgccaagcacggggctcgcagtgctgaaggtaatggagacctggtctggccccgccagagctcagggctatgccctcatgtgcgtactgatgtggctggagagtgagggagtacgcaaaggcccttctgggtcatgcctgcggagctgccgccttacctttgggggagctgaaaaggctgcatggaagagtgacttaggaaccagcctgggcataattagggcacacagtgaggaccgcacagagcaggatcagcgagttgtgtggtttggtgtgtctgctgtaggtggtggtgacggtaggcaggagacagattttggacttgattcttataaagagctggtaatgggctctaaggcctttcagcagagagatattcctagtggctgcgaagttgcttgctgtggtagggcatgaaggcaggaagatagattaggtaaaaatagggagttgaaggagcaagtcagggtggcgagcaggagctgaaatcaggagttgctagagagttgtgtaataaccaaagcttatatggtttgaagcagagatctggagctcagcagaaagaaaaagatcaacgctaacagcttgatttggggaccctggaaatgagcaggaatccaaggcatcagaaagccaggacagccccacagcacagggctgcagagagggcagcaggagctcgggcagcgcaggggcttgtcaaaaggtcataggctgtttttacacctgatgcaaggacagaaacacacacaaggtctggaggattcctgtgagacagccatacatccctatcacttcaaaataagtgaggacattcttgtttgagagggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320864 - DNA, 239 bp, Homo sapiens
  misc_feature (61)..(61): n is a, c, g, or t
tattcctaatcataacttaaagattgtgagaagaaatgtagagaactttaggtgaaacggntttagaattaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320865 - DNA, 1779 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320866 - DNA, 970 bp, Homo sapiens
ggacgcgtgggcgaccacgcgtccggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320867 - DNA, 765 bp, Homo sapiens
ggagatcccataaacggaaatcggcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320868 - DNA, 2154 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaataaaaagtctgatgctgttcgagtcttattaaccagacctgtgttttgagggctgatttgaagctcgcagacccagattgcatttgtttgtgtttcagagacagaatgtgctcctggctcccgtgagaggaacagggattgacacttactattggtgtcttcacattggctcctacccacatagggcgcaagagcggggacatcctgctggtgatgccgcttaggatggtcagttgatttactcattcttcaagggggacattcactctgtgataatttcttctctgtggttgatcagcctccaccagagctgcagcacc

SEQ ID NO: 320869 - DNA, 2257 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaagtgaaaaaaaaaaaaaaaaaaaaaaaaaaaaaaaaaaaaaaaaaaaaaaaaaaaaaaaaaaaaaaaaaaaaaaaaaaaattttaagaaaaaaaaaaaaaaaaaaaaaaaaaaattttttgggcccctttggcccaattattttttaatttaaaaaattttttttttgggggccaaattggggcccatttggcaaattcccccttttggggggggttttaaaaataatgggccgggtttttaaaaagggggggggggaaaaacccgggggttccccaaattaatcgcttgtgagaaaaaccccttttcccaagtgggggaaatagcaaaaaagggcccaccgattccccttttaaaaatattggcccccctttttgggggaagggaaattgaagccttttatttttgtaatccgggttttttttg

SEQ ID NO: 320870 - DNA, 1739 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320871 - DNA, 1475 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320872 - DNA, 1146 bp, Homo sapiens
agctggtaccggtcggagatttatggacccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320873 - DNA, 1507 bp, Homo sapiens
gtacagaactttatgtgaagttgtgaatatcctttataccagaggtttttcaaaaaagttgacaacgccccctcattcattgagatgctgtttcccaagtaggctcccgggcttgtgccaagcacggggctcgcagtgctgaaggtaatggagacctggtctggccccgccagagctcagggctatgccctcatgtgcgtactgatgtggctggagagtgagggagtacgcaaaggcccttctgggtcatgcctgcggagctgccgccttacctttgggggagctgaaaaggctgcatggaagagtgacttaggaaccagcctgggcataattagggcacacagtgaggaccgcacagagcaggatcagcgagttgtgtggtttggtgtgtctgctgtaggtggtggtgacggtaggcaggagacagattttggacttgattcttataaagagctggtaatgggctctaaggcctttcagcagagagatattcctagtggctgcgaagttgcttgctgtggtagggcatgaaggcaggaagatagattaggtaaaaatagggagttgaaggagcaagtcagggtggcgagcaggagctgaaatcaggagttgctagagagttgtgtaataaccaaagcttatatggtttgaagcagagatctggagctcagcagaaagaaaaagatcaacgctaacagcttgatttggggaccctggaaatgagcaggaatccaaggcatcagaaagccaggacagccccacagcacagggctgcagagagggcagcaggagctcgggcagcgcaggggcttgtcaaaaggtcataggctgtttttacacctgatgcaaggacagaaacacacacaaggtctggaggattcctgtgagacagccatacatccctatcacttcaaaataagtgaggacattcttgtttgagaggtaagaggagcattttttaaagacaacagcggcagatttcagcaccctcagcattcagaacatgtgtttaaaccaggaaaaattgtaaattgtatgataattgtccctgtgtatttaaacaacacgccatgggcctgaccttttccttcatccttttgggagtattaaagcacctctaagatggatgagtcagtcaactgcagatctgaaactgctgattttgggaaaacacttaatggcttcctggccttaccagaggggttgggaactagctggggacagccaggccacccttcagttagggtcacttctctgttattttaaacatttgactactctttaatttatgacctcttttttccttttattccatagggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320874 - DNA, 1725 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctattcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaataaaaagtctgatgctgttcgagtcttattaaccagacctgtgttttgagggctgatttgaagctcgcagacccagattgcatttgtttgtgtttcagagacagaatgtgctcctggctcccgtgagaggaacagggattgacacttactattggtgtcttcacattggctcctacccacatagggcgcaagagcggggacatcctgctggtgatgccgcttaggatggtcagttgatttactcattcttcaagggggacattcactctgtgataatttcttctctgtggttgatcagcctccaccagagctgcagcacc

SEQ ID NO: 320875 - DNA, 1453 bp, Homo sapiens
gtacagaactttatgtgaagttgtgaatatcctttataccagaggtttttcaaaaaagttgacaacgccccctcattcattgagatgctgtttcccaagtaggctcccgggcttgtgccaagcacggggctcgcagtgctgaaggtaatggagacctggtctggccccgccagagctcagggctatgccctcatgtgcgtactgatgtggctggagagtgagggagtacgcaaaggcccttctgggtcatgcctgcggagctgccgccttacctttgggggagctgaaaaggctgcatggaagagtgacttaggaaccagcctgggcataattagggcacacagtgaggaccgcacagagcaggatcagcgagttgtgtggtttggtgtgtctgctgtaggtggtggtgacggtaggcaggagacagattttggacttgattcttataaagagctggtaatgggctctaaggcctttcagcagagagatattcctagtggctgcgaagttgcttgctgtggtagggcatgaaggcaggaagatagattaggtaaaaatagggagttgaaggagcaagtcagggtggcgagcaggagctgaaatcaggagttgctagagagttgtgtaataaccaaagcttatatggtttgaagcagagatctggagctcagcagaaagaaaaagatcaacgctaacagcttgatttggggaccctggaaatgagcaggaatccaaggcatcagaaagccaggacagccccacagcacagggctgcagagagggcagcaggagctcgggcagcgcaggggcttgtcaaaaggtcataggctgtttttacacctgatgcaaggacagaaacacacacaaggtctggaggattcctgtgagacagccatacatccctatcacttcaaaataagtgaggacattcttgtttgagagggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaataaaaagtctgatgctgttcgagtcttattaaccagacctgtgttttgagggctgatttgaagctcgcagacccagattgcatttgtttgtgtttcagagacagaatgtgctcctggctcccgtgagaggaacagggattgacacttactattggtgtcttcacattggctcctacccacatagggcgcaagagcggggacatcctgctggtgatgccgcttaggatggtcagttgatttactcattcttcaagggggacattcactctgtgataatttcttctctgtggttgatcagcctccaccagagctgcagcacc

SEQ ID NO: 320876 - DNA, 1833 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 320877 - DNA, 1885 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaacgatgcggcaagttttaaaaattttgtataaacaaaagtgttagactcggta

SEQ ID NO: 320878 - DNA, 1618 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttgctacctcagggcctatccgctatccaataaagatcctgtaga

SEQ ID NO: 320879 - DNA, 1796 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaaataaaaagtctgatgctgttcgagtcttattaaccagacctgtgttttgagggctgatttgaagctcgcagacccagattgcatttgtttgtgtttcagagacagaatgtgctcctggctcccgtgagaggaacagggattgacacttactattggtgtcttcacattggctcctacccacatagggcgcaagagcggggacatcctgctggtgatgccgcttaggatggtcagttgatttactcattcttcaagggggacattcactctgtgataatttcttctctgtggttgatcagcctccaccagagctgcagcacc

SEQ ID NO: 320880 - DNA, 1548 bp, Homo sapiens
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctagccctgctgacctgcagcctgtggccggcacgggcagacaacgcgagccaggagtactacacagcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccaggtgagctcagtactcaacagtgattggttcgtaacagccagagttcacagtcatctgtcgtgaccatgcatcttactaacatgttttttcttttaaaaaatgttgttaccctcactcagtcattttaatatattggattttgcattcagttgtctcttcttacttggttttatgacatggacgtttctgaaaagtacagatcaattattttgtatttgagtttatccgacgtgttgtgttccttcgtgattagtttcaggttatatgcgttttgtgaaaatgtagatttgcttgcatttgtaagagataatacaaatacaaagatgtctcttatccccttcactcatttctccttgtggtaacaacatgtataactgtggtcagtatcataacctggaaattggcatggatgcaatccactgatcttcctaaatacactgaaatctccccacctct

SEQ ID NO: 320881 - DNA, 411 bp, Homo sapiens
acccaaagtagtcatttttatattctcattcaatggtgtgtgttggggggctggtagagaagaacaggaaagaataagagtttggatttgcccatttttttagctatgtgaaagctgggaattttgatttaattgatcataggccatggtaagggacccttacattgtgggttgtgatgaacataagaagatatgagatttgccagacatagtcaagagaattactttggttccctgagcaactcgtctcatttgataccttacctctgtggtgcataggctatcagttaacattgactcatcttttagtcaccagctctttgaattctattatgagggacctgcagccttgattatcactctttggttcagcatatatataaaaactgctttagaaaattgtgaggcatt

SEQ ID NO: 320882 - DNA, 111 bp, Homo sapiens
gctcagagcctccagaaagaatgcagcctgataacaccttgatttcaatcttgtaaaactcagagcagagaaccagctgagccgcaccgtacccagctgtcttacctacaa

SEQ ID NO: 320883 - DNA, 771 bp, Homo sapiens
cccctgggtaaaagttctaaaagttccatgatatcacaagctggtttgcacaacatcatcaaaacaaagaggattctcttcaggttcgtagccagcttcctaaactgcattcctcttagggggctgttctgcttcttactattggttaggcacttgtgattgctagaaacagattctctgttgagctcacataatgacaggttatttgcaggccacctgtggggaaataatggtgacttggatcacgtgcagtttcacatacaggtgatcttttgtatctgtgtgtttcacatctgtggattcagccatctgtggatcaaaaatatttggctaaaaaatatggatggttgtgtctatactgaacatatacagactttttttagttgttattccccaaacaatagagtataaccactatttacatagcatttatatcgtattaggtattataagtaatctagagatgatttaaagtatatgagaggatgtgtataggctgtatgcatttactagaatattttatataaaagatttgaatatctgcgggggattctggaaccagttcctctgtggataccaagggacacctgtttagggggaccttaatgtgattatgcctgttagggatgggaactggattcagagaagctctagaaaactcagcagccagagcttgtacatctttccattagcattgcgccatttatttaactgagctactttgtctctctgcgtatctttttttttttctttgagatggagttttgctct

SEQ ID NO: 320884 - DNA, 459 bp, Homo sapiens
ttagtagtttccaaaagcctcccatgtaaatgtcatgctctcccctcttcctcactctcccgttttcttgagaaacagccatgttttcgttcattgctaagtgacagatgcctgtccagatttagttgccttcccgcttccatagagatgcaaatgtgatcactgattaaggcaacctggatctcgaacctctctacaacgcgaaggactgagctaaaaataaaggtatgggttcaattccactttcagatctgcgttcaaggctagttgatgtgtacagctccaagccaggttcccagttgtaagttattatataccatgtaccacggttttagggcaattcagatgaaatcatctcttatccccctacctccttctctgtcaccaataccctgccagaaaaactacactatccagtaagctttgttattgcaatactttcaaagcaactacaaaatc

SEQ ID NO: 320885 - DNA, 2057 bp, Homo sapiens
ctctggctggacgccgccgccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320886 - DNA, 2081 bp, Homo sapiens
ctctggctggacgccgccgccgccgctgccaccgcctctgatccaagccacctcccgccaggtgagccccgagattctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320887 - DNA, 1743 bp, Homo sapiens
ctctagagcggccgcctactactactaaattcgcggccgcgtcgacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320888 - DNA, 1638 bp, Homo sapiens
ctctagagcggccgcctactactactaaattcgcggccgcgtcgcctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320889 - DNA, 774 bp, Homo sapiens
ctctagagcggccgcctactactactaaattcgcggccgcgtcgccggccacgctcagtgaggacgaagcgcgcctcctgctggctgcactggtgcaggactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320890 - DNA, 1080 bp, Homo sapiens
ctctggctggacgccgccgccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgcaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320891 - DNA, 1917 bp, Homo sapiens
ctctagagcggccgcctactactactaaattcgcggccgcgtcgccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtcccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatg

SEQ ID NO: 320892 - DNA, 238 bp, Homo sapiens
accacaatggaataaaatgagagatcaataacaagaggaacttttagaactatacaaatatatggaaattaagtaacatgcttctgaacaaccaatgggtcaattaagaaattaaaaaagggctgggcgcggtggctcatgcctgtaatcccagcactttgggaggctgaggcaggcagatcacgaggtcaggagatcgagaccatcctggctaacacagtgaaaccctgtctctact

SEQ ID NO: 320893 - DNA, 505 bp, Homo sapiens
tgttacatacacaagaatgcatttctaactaacatatcatgttacttagaagtgtgaggtagcaacagaagaagctgctaagagaattgaaaatgattatctttgagagtgggatgagaggctgtggggtggaggtaagacagtaaacagctgttttaattccaagtattctctgacattttaacaatttatacatgcattcctttaattgaaatccttttcaatcatgctcagtgtcagtttgggtcttctaagaagcagatggcaagatagtactagccatgtgagagatttgtgggggagatgtgaaagatgatgaagaagggagcaggagtaggtggggagagcttttaaactatgatgctagtctgaacatgtgaaaggagagagaaggaaggagggttggatagaaagaggtgcaggctgaagcatggtgctgagaaagtttcagccaggccaaatgttattcattagaggaatcccctgttggacaggattgggctgg

SEQ ID NO: 320894 - DNA, 489 bp, Homo sapiens
gatctcaaactcctgacctcagatgatccgcccacctcgacctcccaaagtgctgggattacaggcgtgagccaccactcctggcaagaggcttttaaagaggctttactgttagataggggacccgaagtttgttccttcgtgaaagagcaacatttgatttatcccacatactatgatttctctacatccaataaaaactattactatgttaaatctgaacaaataaagcagaaatatgaggattccatgttaacccttttgacttagctttatttacattgtgatgaaaaacaatctttttgaagaatttgatgatgtcaacatatacgcatttgatagaaaggttaactagtatcaaaattcacaaaattctaattcataaaatttaaccatgtacaaattccccttatcccaaaataaatatttttcaaagtcctgtttctaaatatatcttgttacattcatgtgaacaagaaacaagcaaac

SEQ ID NO: 320895 - DNA, 932 bp, Homo sapiens
aagaaagaaaaaaatgtacattaaaaaataatggagataggtcagtgaaaaatgtgtctaaaaggggaagttatcagagattttaatactgtttttttaaaaactttctacagatgaaatcaatctcctcaaccccgtgcaatcttgtaacaggtaaacctcttgccctacttttgtatacagattctggaacacgtgtacaaaatatatttaaaaaatacttatacaatgtacacacaaaacatctgtataaaaatatgggactgccatatgaatcaactcactacatttcctttgaaagagacatccatctatcatttctgagaaacagtcttctccaaatcaactgtatcaccagtttaacctaaaacaactgaacatttccaaaaacaaaaacccaccaatggagtgtgtgtgtgtgtacaatctacaagctctaaggagccttttattttcttttggtgttacttaagataaaaagttctggccgggcacagtggctcaggcctataatcccagcactttggcaagaggcttttaaagaggctttactgttagataggggacccgaagtttgttccttcgtgaaagagcaacatttgatttatcccacatactatgatttctctacatccaataaaaactattactatgttaaatctgaacaaataaagcagaaatatgaggattccatgttaacccttttgacttagctttatttacattgtgatgaaaaacaatctttttgaagaatttgatgatgtcaacatatacgcatttgatagaaaggttaactagtatcaaaattcacaaaattctaattcataaaatttaaccatgtacaaattccccttatcccaaaataaatatttttcaaagtcctgtttctaaatatatcttgttacattcatgtgaacaagaaacaagcaaac

SEQ ID NO: 320896 - DNA, 436 bp, Homo sapiens
gaaaccaggaagaatacattatatcagcctaaaagggaattcatttaaaaagaggagttcagaatatacatgtctttacaatttacactaacccatactgtttcacagtaataatatttttaaaaattaagtggaattttctctttttcttttcagtttcttctttcagtggtgggcggggggcatgggagcctcccttctacctctaagaattcctttgtgagcttgagtatgagaataaaagtaagtactgcttttgaaagggcattttaaaatttaatttgtcttacatttatatggtgattttgtaagtaaaaggaagaagatatcttgaaataataatagctttttgtgccaacatgaattttggctcaagagattcaattttccaagtgttgatcttgcattaaaagtgaaataaaaacaatttaggagt

SEQ ID NO: 320897 - DNA, 331 bp, Homo sapiens
ccatgatgggacccaccgtcccacagacaaagggttcttgcgaagccacgactaatttagtgcaaaccgaaataaatatcggcccacagagatcctttacagaacggtttgccttcatttcttctttcagtggtgggcggggggcatgggagcctcccttctacctctaagaattcctttgtgagcttgagtatgagaataaaatcatgtctacattgttacatcgcatccagactcttcttcctagaccgcaattttctctgtactgaacacaaatcactaacttttatagagctctaaaactttttccagtatcgtcaaagtcatcagg

SEQ ID NO: 320898 - DNA, 487 bp, Homo sapiens
ctcttatctatttctatttatcttttagtaaagaaaaacaatatattctgtatctatttttcttttagtgaaactatcatgtcatatactttcccactaaacatgggcttcttcattgctttgtcttttcccttcacttctataatcatattttctttcaaaatgtcttatattcatcatttcttctttatctcctttgcaatcaactaccaaaatgcagatcctcataattctagtttagactgttacaaatgcttcctctgttaatgatagatttttttctctcagatccgcactgcttaatgctgcctgtttacacctttattaaacaacactttcctcatgtcattctgtttacagtcatgtctacattgttacatcgcatccagactcttcttcctagaccgcaattttctctgtactgaacacaaatcactaacttttatagagctctaaaactttttccagtatcgtcaaagtcatcagg

SEQ ID NO: 320899 - DNA, 1965 bp, Homo sapiens
  misc_feature (1469)..(1469): n is a, c, g, or t
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaacaaaaaaaagantttatgatatctttaatcccagtacctagatctaccttagtttctaggtagctggcattgtgggtcacactcaactttccctaactctgaggtttatggacttgggcaactggaagcctggacatgccatcagctgagttgcaaggctgtgggaagagcaagttttagatgtctactcaatatccaagtggagctgttgaggaggcagttgcgatgcatgtgtgtgtctagagtttaagagtgggtcttggatggaaatagaaatttgggagtcagcatttggacagtatcttaaaagctagagggctgtttgagatcaccagtagagtgagtatagttggaggaaaaaaaaaaaactcaggaagtgagggacaaagagagggtgacctgaagcagcctccaagattagggacttttggtaatgggaatgttgactggggagtccagtaatctagagtgcctgagccttgacagtgaatatgtgaggtgatacata

SEQ ID NO: 320900 - DNA, 274 bp, Homo sapiens
tgtccagtgttcgagatcaggcattagagcctgtgtacattttaaacatctcacaacttatgctccctcctgctgtcaggctacatcagcaaaggggtaagctgacgggcatgtgggaataagttgtgagatttttaaaatgttagccaaggctctagtgtgcgtgtgtgtgtgtgtgtgtgtgtgtgtgtgtgtgtgtgtgtgtttgtccgtcccagtggtctgttttttttgagacagggtcttgctctgtcatccaagctagagtgcagtg

SEQ ID NO: 320901 - DNA, 1772 bp, Homo sapiens
  misc_feature (1497)..(1497): n is a, c, g, or t
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaaaaaaaaaaagaaaaaaaaaaaaaaaaaaaaaaaaaaaaaaaacaaaaaaaanaaaaaaaaaaaaaaaaaaaaaaaaacagagacaaaaaaagaagggggggggcggaggagcataaatacacccgggggggcggcacacgagcagacacaaaaaaaatgaaaaaaagagaaggcacaaagaaagaagagaaaaaaaaacagaacacacgacgcggagcaaaaagaaacaacaaaagaaaagaggaaaaaaaaagacaaaggaacaaaaaaggagacgaaccaacgaaaaagaagagagagaagaagcaggggcaaaaaaaacaagaa

SEQ ID NO: 320902 - DNA, 2118 bp, Homo sapiens
  misc_feature (1468)..(1468): n is a, c, g, or t
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaaaaaaaaaaagaaaaaaaaaaaaaaaaaaaaaaaaaaaaaaaacaaaaaaaanaaaaaaaaaaaaaaaaaaaaaaaaagggggggggcccccatccccccgcggggggcccccccccgcccccccgtcttcttctaacaaaaagggggccccctaatgagatgcggagcgatcttatctatataacgcagcagcagaccgcgcgcggccgtgactaacaacagactgcatccgccggggaaaaaagccgccgcaacgcggcgcacctctgcctgacgaagagcgaacacacaatctcttcggacgggaggacaacactacgtgacgagccacaaaccacctccgcagaactcttatacttcagccccgctccccgggagcgatcacactaatacaaccatctgtcccaaggccgcgcgtcctgataggcgcgcggcaaaccccgcccgccgcccatacgagccccgccgcgtcgcacgagcaacccaactcgcgccccaccccctcgcgaccgcgctcccctgacgcacaaccctcctctctcccccccgggggcgtcctccgaacaccaagggcgcgccccccgcccgctcgccagatacgacctcaccgctagccgcactctaatcccgcacccgcaacaaccgcagcgccgctcgcaccgcccgcaccaccacacccactagcgcaccgccgcaccccca

SEQ ID NO: 320903 - DNA, 1551 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320904 - DNA, 1782 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320905 - DNA, 1345 bp, Homo sapiens
tgggaggccgaggcggacggatcaaaagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320906 - DNA, 1486 bp, Homo sapiens
tgcctctgacacaatgaaaatttagcagtgaagtgtaaattgcccattgctagtctgacatggcagcccagaactccagtgcacagcatctaataatcctgaactcattggctataatgcaccattgtcatctacagacaataacgggttttttgtttttaaactgtagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320907 - DNA, 1287 bp, Homo sapiens
ctcctaagatcccttataaggggttttcttaaactgaaggtcaatgtagccatcgtctgtgctggagagcctggaatatttcactttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320908 - DNA, 1588 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcaggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320909 - DNA, 1357 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcaggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320910 - DNA, 1392 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320911 - DNA, 1390 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320912 - DNA, 1553 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320913 - DNA, 1322 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320914 - DNA, 1696 bp, Homo sapiens
cttggaggctgaggtgggaggatcacttgagcctgggaagtcgaggttgcagtgagctgtaatcacaccactgtactccagcccgagcaacagagcaagactcttacctcaaaaaaaaagaaaaaagagaaagaaaagaaaacctgaaaggctgagaaaaacacagagtttattgtagtggtatctgtacaattacaaaaggtgaaaaacaaccaaagtgtccagcagctgtatgtggggcagttaggtaaaactgtagtatgtccatttcggtggaatgttacacatccttacagtttaaatgtatgaaaaggttttaataatattggccacaggacacagagtatggtgtgttcacaactaagagcttaaaaaaaggaaaagaagccaaaatatctggatgagaatgggtcatttttttctttataattgttaatattttgtagtttgtcttcaatttataatcaggaggaaaccttttcccttggtggtatacaactcaaagaaaaagtactgaagagtataaaatactgatctaaggattaggtctgtgacgttttattttaaaatgtgtaactcttacggtactaatgtgtttgcctccttctgccaccagggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320915 - DNA, 1623 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320916 - DNA, 1668 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320917 - DNA, 553 bp, Homo sapiens
ttcgcggtgatctagaggatcccgtagctcgatcaaccacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320918 - DNA, 984 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagggtaaatgcagaagagaactgacaagactgactggctgtgtttctgttaagttagcaggaagaccttccagatggagattttgctaactgtccttggggattagaaggagcaacaagaagaaaactcagctctgagaccctttcagccataatcgcagaagagggccgtggcagggtagtttcaaaccaattccagtattgtccatttctaagaatttttagttgtaatgcgagagccttgtagttacaggttttatttactttattcagaaactaatcagattgtgttttgttaagtggagttttttgttgttgtttctttttttaaggaactttaaaatttttgttaggtggaattttttttatcactgtttatttacactttagtcaaagcccgttcaccttttaagggagaaacttattactaaagccagcagattgtgggaatcttccttctttcctgatgtcatgagatccaatttattaaaggtattctttgtgataaatagta

SEQ ID NO: 320919 - DNA, 600 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagaagcgccccctgttaatttaagaaaacccctccaaagatccctttttagggctatagcgcttgccactgagctcggggctgtttggggcgggtgtcaattatcataaggttcctcctgcttgcaggc

SEQ ID NO: 320920 - DNA, 1445 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320921 - DNA, 834 bp, Homo sapiens
  misc_feature (24)..(24): n is a, c, g, or t
  misc_feature (64)..(64): n is a, c, g, or t
  misc_feature (75)..(75): n is a, c, g, or t
  misc_feature (338)..(338): n is a, c, g, or t
ggtggtgtgttacccagtagctcntgggacatcgctcgggtacgctccacgccgtcgcagccantgctgtggtcnccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaattatattccaaagaaattaaaatgttgaaatccaaatcctagaaataaaatgagttaacttcaaacatttcagaaaacaaaaaaaagantttatgatatctttaatcccagtacctagatctaccttagtttctaggtagctggcattgtgggtcacactcaactttccctaactctgaggtttatggacttgggcaactggaagcctggacatgccatcagctgagttgcaaggctgtgggaagagcaagttttagatgtctactcaatatccaagtggagctgttgaggaggcagttgcgatgcatgtgtgtgtctagagtttaagagtgggtcttggatggaaatagaaatttgggagtcagcatttggacagtatcttaaaagctagagggctgtttgagatcaccagtagagtgagtatagttggaggaaaaaaaaaaaactcaggaagtgagggacaaagagagggtgacctgaagcagcctccaagattagggacttttggtaatgggaatgttgactggggagtccagtaatctagagtgcctgagccttgacagtgaatatgtgaggtgatacata

SEQ ID NO: 320922 - DNA, 1676 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320923 - DNA, 1721 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320924 - DNA, 1679 bp, Homo sapiens
atccgtgggctagctactggagtagttgcagtggcggtctggacgtcaggcagcatccgcgataagtgctgatgctggtgacaggaatcgacggggtatcacgaaaccgctgctctcgaggctcatgagtcgtgtgcgagaccgcgtctcctccgatcagaaattcaatgctccgagtcattcagtgtggtggcatattgtgccctcatgagacatcggctcttgccttcttttcccagtaagcaccgatttcgttatctagttattataactgatcttatgattaccgtcagtcaggtttcttttatattcctcttctccatgtgactcggttcatgcatgaacgggttaggagaatcatcctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320925 - DNA, 1851 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagggtaaatgcagaagagaactgacaagactgactggctgtgtttctgttaagttagcaggaagaccttccagatggagattttgctaactgtccttggggattagaaggagcaacaagaagaaaactcagctctgagaccctttcagccataatcgcagaagagggccgtggcaggtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320926 - DNA, 1451 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgcaggaagaccttccagatggagattttgctaactgtccttggggattagaaggagcaacaagaagaaaactcagctctgagaccctttcagccataatcgcagaagagggccgtggcaggtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320927 - DNA, 1391 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320928 - DNA, 1498 bp, Homo sapiens
gacttccggcgcactgatcccgcctggggccggctgagtggcacttaagcgggccatgccatgcaaccttgggcgctgccaaccgtgggcgagctctgggtgtgcgggcggcctggcgcggcgctccgatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtagtttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaa

SEQ ID NO: 320929 - DNA, 2081 bp, Homo sapiens
ttgccaaaacaactacatgaataaacatttacacacaaggaccccaaggcactgcttcccaccccccacgccctcccttcctgacgtgcccgacaaaccaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 320930 - DNA, 3459 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcaaaaaaaaaaaaaaaaaaaaaaaactcgagactagttctcctcgtgccgaattcggcacgaggtctcgagtttttttttttttttttttagaaaggctggcatctgcttctggtgagggcctcacgaagcttacaatcatggcagaaggtgactcgtgc

SEQ ID NO: 320931 - DNA, 1818 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccggatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 320932 - DNA, 965 bp, Homo sapiens
acagactaaggtacatcttgcgggaagtgcgctgttcctgacagggatactcctgggccgcaaaatgcttggcatccctaccagcattgcaatgtcctaatgagacctcaaattcgggtgattctctaaagtcgccctgtagtctatacttgtgccagtagtcgctcgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 320933 - DNA, 2813 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagaggacgaagacgcagtcttctcccatcagaattgtctgttccgtgataggattagccatgaaatgttggccatgattatgtggaacacagatcatcagcattggggctatttccagcaagactgtactaaacacagtaacttgtatccttatgtatctgatgacgcagtctggtccggctg

SEQ ID NO: 320934 - DNA, 1883 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatcccagggttcccaataaaaatgtgaaaacca

SEQ ID NO: 320935 - DNA, 285 bp, Homo sapiens
gttctctcccgcttcttgcagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaactt

SEQ ID NO: 320936 - DNA, 3301 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 320937 - DNA, 3074 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 320938 - DNA, 2563 bp, Homo sapiens
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgca

SEQ ID NO: 320939 - DNA, 2006 bp, Homo sapiens
  misc_feature (1949)..(1949): n is a, c, g, or t
  misc_feature (1998)..(1998): n is a, c, g, or t
ctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgacccttacccgtatgagacctacgagccttaccccctatggtgggaatgaagggccagcctacacctacnggctctcaatcccttcaagattcccgggaattgccccaagaattgcgantgccaacc

SEQ ID NO: 320940 - DNA, 492 bp, Homo sapiens
gatcgtgccattgcactccagtctaggccacaacagcaaaactccgtctaaaaataaataaataaataaaactgaatgaatataaacagaaaccacagatgctattacatattaaattgataatataaccattacaggcgtgagccaccaagcccggcctaaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcgtttaaaccatggtaaagaacagcttttaaaaaaaaatcgcttctcagccttttggctaagctcaagtgtaaaaaaaaaaa

SEQ ID NO: 320941 - DNA, 507 bp, Homo sapiens
  misc_feature (31)..(31): n is a, c, g, or t
  misc_feature (98)..(98): n is a, c, g, or t
ttttgggtagatgttaagggtgaccacaggntggtccaagtgcggtgctgtttacaactaattgatcacagctacctaaagatttatttgttcttctncattcctgttgcttcacttgactagccttaaaaaaaaaaaagtggccattacaggcgtgagccaccaagcccggcctaaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcgtttaaaccatggtaaagaacagcttttaaaaaaaaatcgcttctcagccttttggctaagctcaagtgtaaaaaaaaaaa

SEQ ID NO: 320942 - DNA, 680 bp, Homo sapiens
tacaggcgtgagccaccgcgcccggccagcattcgtatatgtaataataataagtggcaagtaggtaccttctcgtagaaataataatcacatttcttaacaggtattaaggacaaggatcattgttctcctgttcactgttgtattctcattgcccagcactacatttggcacatggtggatactttcacttggttggatgaattttcaacatttagagactttaaaaaaatcttatttcactaggatagggaattggccagttcaataatttttctatcagaccctgacacaactttttttttcttttaaaaatatattacaggcgtgagccaccaagcccggcctaaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcgtttaaaccatggtaaagaacagcttttaaaaaaaaatcgcttctcagccttttggctaagctcaagtgtaaaaaaaaaaa

SEQ ID NO: 320943 - DNA, 281 bp, Homo sapiens
aaaaaaagtatgattacacacacacgcagacttacacacacttaaaaggacaacagtaaagcgaatttacaaaccaggccaagaaagagattattaaatctcagaaagctgtgtgcctcttctaaactgcatcctcctctcccaccaatactgtctccgtggatttgactgcgtatacatcttttccagaaaatatatttcctaaattttggtaattatttgtgaatgaactcaggcgcttcagtatttttggaaacaatctttttctgtattgattcaag

SEQ ID NO: 320944 - DNA, 257 bp, Homo sapiens
atggcagaattacattgatgaagaacatatgtgtgactgccagggataacacaggtagtgatagaacaattctgtgtcctgattgtggtgttattacacaaatctctacatataaaatctcatagaactagatacccccccataatacagtcagccctctgtatctatgggttctgcatttgtgaactcaacaacttatggatcaaaaatattcagagaaaaattgtatctttactgaacatgtacagacttttctt

SEQ ID NO: 320945 - DNA, 1562 bp, Homo sapiens
atgaacacctttctgcccgtggacgccgccgaagaagcatcgttaaagtctctcttctccctgccgtcatgtctaagtcagagtctcctaaagagcccaaacagctgaggaagctcttcattggagggttgagctttgaaacaaccaatgagagtctgaggagccattttgagcaatggggaacgctcatggactgtgtggtaatgagagatccaaacaccaagtgctccaggggctttgggtttgtcacatatgccactgtggaggaggtggatgcagctatgaatgcaaggccacacaaggtggatggaagagttgtggaatcaaagagagctgtttcaagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaacacgaaacaaggtggctatggcggttccagcagcagcagtagctatggcagtggcagaagatttaattaggaaacaaagcttagcaggagaggagagccagagaagtgacagggaagctacaggttacaagagatttgtgaactcagccaagcacagtggtggcagggcctagctgctacaaagaagacgtgttttagacacatactcatgtgtatgggcaaaaaactcgaggactgtatttgtgactagctgtataacaggttattttaatttctattctgcggaaagtgtaaagcattccaacaaagggttttaatgtagttttttttttgcacccatgctgttgattattaaatgtaatagtctgattgtgacactgaataaatgtctttttttaaaaaaaataaaataaaaccgatgaacattcaaaatgaaaatagagcttaatcaatttaccaactgtatttaaaaataggtacgggggtatgaattttagaaaatgctttcatgtggtggaattttttcttactagtttttataataacaaatcataatttaaggaaaacttgttgttttgtaaaagttttaactttttagtt

SEQ ID NO: 320946 - DNA, 510 bp, Homo sapiens
atggcaaaaccccatctctacaaaaaatacaaaaattagtcaggcgtagtggcaggcgtctgtaatctcagctattcaggaggctgagacaggagaatcgcttgaacccaggaggcagaggttgtagtgagctgagactgtgccactgcactccagtctgggtgacagagcaagactctgtctcagaaaaagaaaaaaagagatgtaacataacagagttattctcgaaacattgtagtttcatttcaagatcaaataccttactaaatacattaaaagcactatttattatgaaatgttggtccacttaagtagcatttttctggggtcagtcttcctcagtttgggctgatctcctctattcaaacgagtatcacaaacacaaatggctaataactgttagggtggcctagacttcacttgtccttcagtatccgttttcttcttctcccacagtaaaataactttcatctgggcaaatgtccacctagaataagactacatttccca

SEQ ID NO: 320947 - DNA, 2524 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 320948 - DNA, 229 bp, Homo sapiens
ctcatacaacattgtatgtgagagaaatataaatatttatccataggattaatactcatatggagtataatgtggaaaagtgcagaactaaagaaataagtctatccgaaaacaaaagcacacttttccacattatactccatatgagtattaatcctatggatacatattaaaacaagtgtctcatacaacattgtatgtgagagaaatataaatatttacaacctga

SEQ ID NO: 320949 - DNA, 2796 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaaaaaaaaaaaaaaaaaaacccaaaatttaaacaaaacacaaaaactgacacaaaaaaacactgtttgggggccctcgggacccggaaaaaagttttttcgaaaacccctcgtgtgggggggcggagggccccatatgttatgcaacacgggcccacacgtgtgtgcacgagagaaaacctggcacgacacacggctgttgggttttccaccaaataaaaacgcgggcgaaccgagtcttcgacactccgaagggttcgaggacaaagggtcca

SEQ ID NO: 320950 - DNA, 1981 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtgatttttttaatgaatatttgggaatgaattgcagacgtgatgcccatttacccctaaaatacttcagtgtatgtttcctgaatcaagcaaggacataatgttacaaaccacagcacagctgtcattatcaagtaaacacatctgaaacatcacaaccttctaattcatacccc

SEQ ID NO: 320951 - DNA, 1144 bp, Homo sapiens
  misc_feature (22)..(22): n is a, c, g, or t
  misc_feature (25)..(25): n is a, c, g, or t
tcgcggacgcgtcgactacganacnacagaagggagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 320952 - DNA, 1136 bp, Homo sapiens
  misc_feature (22)..(22): n is a, c, g, or t
  misc_feature (25)..(25): n is a, c, g, or t
tcgcggacgcgtcgactacganacnacagaagggagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttattttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 320953 - DNA, 776 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 320954 - DNA, 2076 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctga

SEQ ID NO: 320955 - DNA, 2731 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaaaaaaaaaaaaaaaagaaaaaaaaatttttgtggggcgccggcgccccgaaaaaatttttcagcaccacttttttggggcggggcccaagtgttgacatgggcagggtccaggaaaccggccgactgggtgggttcccaccaaaaaacccgggcgcggggtttgaaaccccaggggtgtgggctcggctcacgggccggtaccgccgg

SEQ ID NO: 320956 - DNA, 2427 bp, Homo sapiens
agccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 320957 - DNA, 1028 bp, Homo sapiens
  misc_feature (230)..(230): n is a, c, g, or t
  misc_feature (242)..(242): n is a, c, g, or t
cgctgctggagctggcaaggtcaccaagtctgcccagaaagctcagaaggctagatgaatatcatccctaatacctgccaccccactcttaatcagtggtggaagaacggtctcagaactgtttgtttcaactggccatttaagttcagtagtaaaagactggttaatgaaaacaatgcatcgtaaaaccccttcgagaaaagggaaaagggaagaaatgggtttttttnttgttgggggancccccctttgggggtggttttcttttttgcgtgtggcagttttaagttattagttttttaaatcagtactttttaatggaaacatccaaaaatttgtcacagaattttgagacccattaaaaaagtttaatgagaaaaaaaaaaaaagcaaacctgcctctaatttgtctgctccaccttggaaagtgatatcttaaatttcaaaaagaattaccacatttatccctggcgaggacgtgaggaacagtctaatctcatacactgttggcaggaatgtaaattggcacggcatttttaaaagggaaattaacagaatttatcaaaatattaattggacgtaatcttcaatttagcagtttcactaataaatattgtagagaaatccttatatgcacaaaaaagtatgtacaataatactacagcattgtttgtaatagtgaaaaaaatggaaacaaaatgaccatctatcaatgggaaatggttaatggtatatctattactatgagatgttttgaactaaagggttagccattgaaagagatccaagattttttaaagccaactgcaaaaaacatacagcattatcaacttttgtcgaaacaccccaaaattatatatgcatgcatgtaaatgcattgagaaggctttcaaaggatataaggctaagtgggggaaagaaacttattttctcctccatatatttctctgttgtttaagatttatatagctattattgtcactgaatacatgttaaaagaaaaataaagacagaaaagtggtttatta

SEQ ID NO: 320958 - DNA, 414 bp, Homo sapiens
  misc_feature (324)..(324): n is a, c, g, or t
  misc_feature (341)..(341): n is a, c, g, or t
  misc_feature (392)..(392): n is a, c, g, or t
  misc_feature (398)..(398): n is a, c, g, or t
aatcccatgttgcacaactgctgtgagggttggagctcatgaaggaaagacctagctcgcgcctgcacacagaaggtgctcacatcaatgacgtcatccccattcccaacgtcatcacgctcaaggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagtttgctngacatccagggaggaanttttcaattgttgccgtgaaaggacacacagcccaaggacggggttggagntggatntttggcagacccaaca

SEQ ID NO: 320959 - DNA, 2212 bp, Homo sapiens
cagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaag

SEQ ID NO: 320960 - DNA, 2444 bp, Homo sapiens
cagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggagcccacacgatgaagacccccaggcagtgacgtatgccccggtgaaacactccagacctaggagagaaatggcctctcctccctccccactgtctggggaattcctggacacaaaggacagacaggcagaagaggacagacagatggacactgagagagtcctctcctctccaggcccccaggcctccccacccccaccacgttccttcctctcactctcccccgctgcaggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaag

SEQ ID NO: 320961 - DNA, 1750 bp, Homo sapiens
tggtacggtccgaacgtatcgtatgatcaggacctcctggagattctggtccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggagcccacacgatgaagacccccaggcagtgacgtatgccccggtgaaacactccagacctaggagagaaatggcctctcctccctccccactgtctggggaattcctggacacaaaggacagacaggcagaagaggacagacagatggacactgagagagtcctctcctctccaggcccccaggcctccccacccccaccacgttccttcctctcactctcccccgctgcaggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaag

SEQ ID NO: 320962 - DNA, 2144 bp, Homo sapiens
cagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggagcccacacgatgaagacccccaggcagtgacgtatgccccggtgaaacactccagacctaggagagaaatggcctctcctccctccccactgtctggggaattcctggacacaaaggacagacaggcagaagaggacagacagatggacactgagagagtcctctcctctccaggcccccaggcctccccacccccaccacgttccttcctctcactctcccccgctgcaggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaag

SEQ ID NO: 320963 - DNA, 887 bp, Homo sapiens
aatcccatgttgcacaactgctgtgagggttggagctcatgaaggaaagacctagctcgcgcctgcacacagaaggtgctcacatcaatgacgtcatccccattcccaacgtcatcacgctcaaggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaag

SEQ ID NO: 320964 - DNA, 1442 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtccggggccccaacaactactacagtatggctcagcgctagcgctggcaatacaggatgatgtaatggcgtgtgcctggaggaggggtatgtggaagaggtgacatctaagcttaatgtgaagaaatccctgtgtgcaaatatctgggaggagcataacaggcagagagaggagcagggatgaaggcctgagggcagaggagctgacgtgttggaggaatagaaagaatgccagaggtatggctcagcgctag

SEQ ID NO: 320965 - DNA, 732 bp, Homo sapiens
aaaaactacggctaggtacgacgctcagtgtgtaatcggccgaggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagtataccccaggaggatcctctagatcgataacgggagctgcat

SEQ ID NO: 320966 - DNA, 1461 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacaaaaaaaaaaaaaaaaaaaaaacaaaaaattttggggggcttgggcctgaaaaagtttttaaaacaattggttgggacgcccgcgaggcacccaaggaaggtaaagagtggaaacgtgggcccaaaagggtgtttcccagaggaaaaaacgagggaacacaaaaaaagggctgagaatctctcaacgaataaaaaaaagcgccccggggagaaccagagaagagtttctagaaacaatctccaaaagagacgatcatgagagaggaaacaataacggagggaccaccaacacaaaaagggggaatccaacacgagaaaaacacgaaaaatactacagaattacagacccacgggcagtggagtgaacaaagaacaaaaacgagaaaaaagaaaaagaaagaaacaagagagaaaggaaaaggaaaagaaaagaaaagtagaaaagaagagccagaagcggaagagaaaagaacggagaaggaagaaagagaccgagagaaagaaaagggcacagaggacagggaacaaggggaaaagcaagaggagaggagagaaaaaaaagcaaaagaggaaaagcaaacgaaagaaaaggggagaaaggaaagag

SEQ ID NO: 320967 - DNA, 325 bp, Homo sapiens
tggatatgtgttgaatataaaactgaatgatacctgcacagattaatgattgggaatttgacatcagacaaatctggctttgaaacatccacctgggcaacagagagagactccttctcaaaaaataaataaaaggatactatggtgatacccagtttacactttgggaaaccgaggttgtcatttcactgaagtgaggtcactcgctcttgtatgactcaatatgactcttgtaaatgacttattcatgcatctttgggacacagtttcctcatatgaaaacccaggacctgatacctcttcaggaagatgcatggggcgttgt

SEQ ID NO: 320968 - DNA, 1751 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320969 - DNA, 2008 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacaaaaaaaaaaaaaaaaaaaaaacaaaaaattttggggggcttgggcctgaaaaagtttttaaaacaattggttgggacgcccgcgaggcacccaaggaaggtaaagagtggaaacgtgggcccaaaagggtgtttcccagaggaaaaaacgagggaacacaaaaaaagggctgagaatctctcaacgaataaaaaaaagcgccccggggagaaccagagaagagtttctagaaacaatctccaaaagagacgatcatgagagaggaaacaataacggagggaccaccaacacaaaaagggggaatccaacacgagaaaaacacgaaaaatactacagaattacagacccacgggcagtggagtgaacaaagaacaaaaacgagaaaaaagaaaaagaaagaaacaagagagaaaggaaaaggaaaagaaaagaaaagtagaaaagaagagccagaagcggaagagaaaagaacggagaaggaagaaagagaccgagagaaagaaaagggcacagaggacagggaacaaggggaaaagcaagaggagaggagagaaaaaaaagcaaaagaggaaaagcaaacgaaagaaaaggggagaaaggaaagag

SEQ ID NO: 320970 - DNA, 1236 bp, Homo sapiens
tgatctagaggatcccattcgtgacggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320971 - DNA, 1581 bp, Homo sapiens
ctcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaagtgagagatgactggaatggacccacgcgggggtggtgggggaatgattggaagacttatggcagaactgagtgaggggttagatttttggtgcgtggaggcttaactggtcggagtggcaggattgggattcgggcttttcctgatggtggattccaggcaagaccaagtgggaagtgaggactgcccggagtgataaaagaatgaggctgaaaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320972 - DNA, 1697 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320973 - DNA, 1666 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320974 - DNA, 1036 bp, Homo sapiens
actactactactaaattcgcggccgatcgatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320975 - DNA, 1575 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320976 - DNA, 1257 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagtataccccaggaggatcctctagatcgataacgggagctgcat

SEQ ID NO: 320977 - DNA, 1915 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagtgaattgggcccggtcatgggattgtggataacggctctcatctcaccacccttggctgttgacatgtgtggccacgtgtgtcaaacctgagcatggaattggttcagcaggcagggattgtgcggcctgtcttagcccatcttccgtcctagatacccatccaggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320978 - DNA, 1216 bp, Homo sapiens
  misc_feature (1189)..(1189): n is a, c, g, or t
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtggntcctggggggtaccgacgctcgacatt

SEQ ID NO: 320979 - DNA, 1566 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagtgaattgggcccggtcatgggattgtggataacggctctcatctcaccacccttggctgttgacatgtgtggccacgtgtgtcaaacctgagcatggaattggttcagcaggcagggattgtgcggcctgtcttagcccatcttccgtcctagatacccatccagtgagtcatgagacttcacctccggccaccaaaactgtggaaccctcagtttctccttctctagaatgggttgaccaaatcccagcagccccttgggttgccgtgtgcacaagtgacatcccacgggcagatggatgtgacatacaaatcccttgaggagtaaaagggtgtcgaagtggtggctgagctgatgcactcgggcagagcaccaaatcagaatgagtttccatgccttaggtgcaaaggcaagcccagaggcattcgagtgaggagtggtagccagtacccactacctaccgcatggcctaagcgatattggaggcactcctccccat

SEQ ID NO: 320980 - DNA, 1793 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgagtgtcactggggttggttgggggtgataatctgggggtcatggcaggaatggtagcactggtggttggggaagagacctcagtcacctcctgagagctcactctgtcacccacaggttgcagtgagccgagatcacgccattgcactccagcctgggtgacagagcgagactctgtctggggaaaaaaaaaaaaaaaagaagaaggtgaaattgaattttagtgatggtgacagctggtaactgatctgtcactcaggccaaacactatcctcagtgctttaaagatgttgattcaccaaatcctcacagttgacccagagaggtgtgtaattagggtcccagtctcaacacagagaaactgaggcacagagaggtgaagttacttgtcaagggtcgttgggcagagtacgattggtgagaaaagagagcataggacacgtgggcaagtgctggccccatagggtggggatggagcctttgtgatcactctactcgtctctaatccctcctttcctgcagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320981 - DNA, 1384 bp, Homo sapiens
tggaggtgggcgctgcacgcatgttggctgctgtctttatcaaaatttcttagaggtggcagctttttctgcaagactttgcttcatttggtctcaggcgtttgagcacgagcaacgcttggtgttgcaggaggagggctgggaccaggctatggaaggtgaaattgggctgggtgcagtggctcccgcgcaccaaggtggatcctcccacctaggctcactctgggaggctgaggtgggaggatcgcctgaggtcaggagttcgagaccagcctggtcaacatggtgaaacctcatctctactaaaaaatacaaaaaaaattagccggatgtggtggcgggtgcctgtaatctcagctactcgggaggctgaggcaggagaattgcttgaacccaggagggtggaggttgcagtgagccgagatcacgccattgcactccagcctgggtgacagagcgagactctgtctggggaaaaaaaaaaaaaaaagaagaaggtgaaattgaattttagtgatggtgacagctggtaactgatctgtcactcaggccaaacactatcctcagtgctttaaagatgttgattcaccaaatcctcacagttgacccagagaggtgtgtaattagggtcccagtctcaacacagagaaactgaggcacagagaggtgaagttacttgtcaagggtcgttgggcagagtacgattggtgagaaaagagagcataggacacgtgggcaagtgctggccccatagggtggggatggagcctttgtgatcactctactcgtctctaatccctcctttcctgcagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320982 - DNA, 1219 bp, Homo sapiens
gtatttgaattcccttcttttctttcttccctccctcccctccccatcagctagttcttctggagctcaacttcttgccaaccacagggaccaagctgaccaaacagcagctaattctggcccgtgagtgtcactggggttggttgggggtgataatctgggggtcatggcaggaatggtagcactggtggttggggaagagacctcagtcacctcctgagagctcactctgtcacccacaggttgcagtgagccgagatcacgccattgcactccagcctgggtgacagagcgagactctgtctggggaaaaaaaaaaaaaaaagaagaaggtgaaattgaattttagtgatggtgacagctggtaactgatctgtcactcaggccaaacactatcctcagtgctttaaagatgttgattcaccaaatcctcacagttgacccagagaggtgtgtaattagggtcccagtctcaacacagagaaactgaggcacagagaggtgaagttacttgtcaagggtcgttgggcagagtacgattggtgagaaaagagagcataggacacgtgggcaagtgctggccccatagggtggggatggagcctttgtgatcactctactcgtctctaatccctcctttcctgcagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320983 - DNA, 611 bp, Homo sapiens
gaggtgatctagaggattcggcctgactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320984 - DNA, 614 bp, Homo sapiens
ctcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaagtgagagatgactggaatggacccacgcgggggtggtgggggaatgattggaagacttatggcagaactgagtgaggggttagatttttggtgcgtggaggcttaactggtcggagtggcaggattgggattcgggcttttcctgatggtggattccaggcaagaccaagtgggaagtgaggactgcccggagtgataaaagaatgaggctgaaaaggtgggctgtgtagagggtgtgtggttaagaccaggctgggttaggatctgagagatctggggcttaggctcgcatctgttgggagagggggcagcctagttgtgaaggcaggactgaacctagaagaaatattcttacaagtagagaacaagaatacggg

SEQ ID NO: 320985 - DNA, 626 bp, Homo sapiens
gaagtgaggtcactcgctcttgtatgactcaatatgactcttgtaaatgacttattcatgcatctttgggacacagtttcctcatatgaaaacccaggacctgatacctcttcaggaagatgcatggggcgttgtgaggattcctggagcctggggtagagggctcgctaggcccttaaatcctccttaacctgcttccccatcccacgtccacagggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaagtgagatggcaaggggcaggggaggacctggccaaagtgggtggtgcaggggtggtcttaggagggctttcctgaaggagtggccagggttcacccatctttccacccacggacccatcctcttgtttgtccaacaaatactgagtcccagctgtgtgcctggcactgtggtaggttgtcagactgtgcagtgagccaagcaggtgaaattcatgatcttgtggtgatgacactggggtgtgga

SEQ ID NO: 320986 - DNA, 1769 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatgattcaaatgacatgtgaaa

SEQ ID NO: 320987 - DNA, 1102 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcaggtgcgtagcggggccgggccctgtggagtttggaa

SEQ ID NO: 320988 - DNA, 442 bp, Homo sapiens
  misc_feature (158)..(158): n is a, c, g, or t
tacccagcgctgagccatacccacttatgttgtcattctaattgtttacgtacatggatataccggatatgtaaaattttctttcctgtaccctttgatagtaggttgccggtgtcatgccacttccggatgcttcagtattgccagcgctagcgctnagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagtatggctcagcgctggggtccttctagataa

SEQ ID NO: 320989 - DNA, 2358 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatgaaaaaaaaaaaaaaaaaaaaaaacaaaaaattttggggggcttgggcctgaaaaagtttttaaaacaattggttgggacgcccgcgaggcacccaaggaaggtaaagagtggaaacgtgggcccaaaagggtgtttcccagaggaaaaaacgagggaacacaaaaaaagggctgagaatctctcaacgaataaaaaaaagcgccccggggagaaccagagaagagtttctagaaacaatctccaaaagagacgatcatgagagaggaaacaataacggagggaccaccaacacaaaaagggggaatccaacacgagaaaaacacgaaaaatactacagaattacagacccacgggcagtggagtgaacaaagaacaaaaacgagaaaaaagaaaaagaaagaaacaagagagaaaggaaaaggaaaagaaaagaaaagtagaaaagaagagccagaagcggaagagaaaagaacggagaaggaagaaagagaccgagagaaagaaaagggcacagaggacagggaacaaggggaaaagcaagaggagaggagagaaaaaaaagcaaaagaggaaaagcaaacgaaagaaaaggggagaaaggaaagag

SEQ ID NO: 320990 - DNA, 1364 bp, Homo sapiens
ctcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaactagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320991 - DNA, 1190 bp, Homo sapiens
aagctagtacgaggactggggtgtaaatcggccgagggcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320992 - DNA, 1601 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320993 - DNA, 1020 bp, Homo sapiens
  misc_feature (8)..(8): n is a, c, g, or t
  misc_feature (42)..(42): n is a, c, g, or t
tgctgccnacagggatgtcacagtcagtagataagagccatnttaagactctctgtatcatcctcagaaggacagggagaatttatgtaacatctgaagcagtgttaagattcctgctgtgttcatcattcaggaaaggagagagcaccacctacagcgagcacctgtattggtggtgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320994 - DNA, 1245 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagtatggctcagcgctggggtccttctagataa

SEQ ID NO: 320995 - DNA, 1069 bp, Homo sapiens
gtgcctcttgatgggtacaaggaaccccctcaggatctatgaagtggggtgcagcaccctggtgatgggtgttatgagaagagatgccctcatgtgagtcccaagctgggtttcagacctgaaatcctgtggctgggagtgggattcagagtgtgggcccaggagtcagagatttcagtggggatcacccgtggcccttgcttgctttgcgagtctggtcaagtttctccccttctgagccttgatgaataaaacagggcccttcacatattcctgccatcagtgctgaactccagggtcagagctgacacatgtcaggtctggggggacaggtcctgggaggttgttgatgctcagtaatgaggagcttctcatcttcccccagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatga

SEQ ID NO: 320996 - DNA, 1072 bp, Homo sapiens
tataaaatgagaataacacagctctccaaatggcacgacacccgctaccttttggcttggagacgctgccccgaaggcggaacctccaggacagctacgtagcgtcccgagcactcagactgaagccagggcagccatgttcattattggaaccgtgaggtgggtagggggggtggtgttgagacagctgtcattttcagttagggcaaaagccaacttccggtcaccatcttgagtgacgacagaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcagtcacaagcccgcaagcaagcagttatagtgtagaggatcacccacgtggatcacctaaacatcgatagaaccgccgcagcgtacactttcctgcttgaagtccagcactacgcctcgcacagac

SEQ ID NO: 320997 - DNA, 520 bp, Homo sapiens
cgtgtgaccgtccgtgagagtgtgaccatccatgtgagcatctgtgtgaccgtccgtgtgagcatccatgtgagcctgtgaccgtccgtgtgagtgtgtgaccatccgtgtgagagtgtgaccatccatgtgagcatccgtgtgagcatccgtgtgaccgtccgtgtgacgcgtgtgtgtaggggttgtctgtgtaggtgtatgagtgtaggtgtgtgtggaggtgtgtgtggtgggtgtagatgtgtgtgtggggtgtgtgtaggtctactgggtggaggtgtggtgtgtggaggtgtgtgtggtggactgtggtggctggtgtagacgggatgaggcaggtatttgtgtgtacccaccgggtggggtgagccacaaccgctcttgtattgccagcgcccttgggtagggtgaggcagagctgacatgaaactaaacaaagctttctcaactctctccacaaggatccacagggatcccagatggtgtcctcagaaaccccagtgatagctggcagggg

SEQ ID NO: 320998 - DNA, 2666 bp, Homo sapiens
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgctgcattgtggctcgcaagaagcctgggccctgagccaggagggccagccagaggtctggtcaggctgtgaggccttggccatctgtatgctagagaggggtgaggaatggatgctgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcctgagtagctgggactacaggagctcgccaccacacccagctaattttttttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagatatggggtttcaccgtgttagccaggatggtctcgatctcctgacctggtgatccacccacctcggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggccagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagagtggaagccacgggctcaagcagccaaggcagggcggacagtgtgagagagctagtgtaagctgttgatgagagctgttgctgaataaaaccatattcacctgccggaataaaaaaatatatattattagataattttttagttatatattttttgttttattggtgggggggttattgtataatatatttattttattttggagggggggcccttacccaaattggcccttttatggagtgtgttttaaaatatcagggg

SEQ ID NO: 320999 - DNA, 2564 bp, Homo sapiens
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgctgcattgtggctcgcaagaagcctgggccctgagccaggagggccagccagaggtctggtcaggctgtgaggccttggccatctgtatgctagagaggggtgaggaatggatgctgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcctgagtagctgggactacaggagctcgccaccacacccagctaattttttttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagatatggggtttcaccgtgttagccaggatggtctcgatctcctgacctggtgatccacccacctcggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggccagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtgtgtggaagccacgggctcaagcagccaaggcagggcggacagtgtgagagagctagtgtaagctgttgatgagagctgttgctgaataaaaccatattcacctgcc

SEQ ID NO: 321000 - DNA, 2720 bp, Homo sapiens
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgctgcattgtggctcgcaagaagcctgggccctgagccaggagggccagccagaggtctggtcaggctgtgaggccttggccatctgtatgctagagaggggtgaggaatggatgctgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcctgagtagctgggactacaggagctcgccaccacacccagctaattttttttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagatatggggtttcaccgtgttagccaggatggtctcgatctcctgacctggtgatccacccacctcggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggccagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtgtgtggaagccacgggctcaagcagccaaggcagggcggacagtgtgagagagctagtgtaagctgttgatgagagctgttgctgaataaaaccatattcacctgccggaataaaaaaatatatattattagataattttttagttatatattttttgttttattggtgggggggttattgtataatatatttattttattttggagggggggcccttacccaaattggcccttttatggagtgtgttttaaaatatcagggg

SEQ ID NO: 321001 - DNA, 4961 bp, Homo sapiens
  misc_feature (4697)..(4697): n is a, c, g, or t
ctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccagctgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgctgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttgaaaaaaanaaacaaaacgaaagctggacatatatgctaaaaaatattaaccttggggggggccccgagcccaaatgccccttaagggagatggtataaaattcaacgggccttgttttaacaccgtctggatgggaaaaccctgtgttttaccaactttatcggcttggaagaaaatccccttttcgcaagtgggagtattaccaaaaagccccgaccgtttcgccttcccaaacatttgcccaccctgatgggaaatggttgagctttttt

SEQ ID NO: 321002 - DNA, 4907 bp, Homo sapiens
  misc_feature (4643)..(4643): n is a, c, g, or t
ctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccagctgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgctgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcatttagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttgaaaaaaanaaacaaaacgaaagctggacatatatgctaaaaaatattaaccttggggggggccccgagcccaaatgccccttaagggagatggtataaaattcaacgggccttgttttaacaccgtctggatgggaaaaccctgtgttttaccaactttatcggcttggaagaaaatccccttttcgcaagtgggagtattaccaaaaagccccgaccgtttcgccttcccaaacatttgcccaccctgatgggaaatggttgagctttttt

SEQ ID NO: 321003 - DNA, 4908 bp, Homo sapiens
  misc_feature (4644)..(4644): n is a, c, g, or t
ctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccagctgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgctgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctaccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttgaaaaaaanaaacaaaacgaaagctggacatatatgctaaaaaatattaaccttggggggggccccgagcccaaatgccccttaagggagatggtataaaattcaacgggccttgttttaacaccgtctggatgggaaaaccctgtgttttaccaactttatcggcttggaagaaaatccccttttcgcaagtgggagtattaccaaaaagccccgaccgtttcgccttcccaaacatttgcccaccctgatgggaaatggttgagctttttt

SEQ ID NO: 321004 - DNA, 221 bp, Homo sapiens
cggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtggggg

SEQ ID NO: 321005 - DNA, 4907 bp, Homo sapiens
  misc_feature (4643)..(4643): n is a, c, g, or t
ctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccagctgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgctgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaaattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttgaaaaaaanaaacaaaacgaaagctggacatatatgctaaaaaatattaaccttggggggggccccgagcccaaatgccccttaagggagatggtataaaattcaacgggccttgttttaacaccgtctggatgggaaaaccctgtgttttaccaactttatcggcttggaagaaaatccccttttcgcaagtgggagtattaccaaaaagccccgaccgtttcgccttcccaaacatttgcccaccctgatgggaaatggttgagctttttt

SEQ ID NO: 321006 - DNA, 202 bp, Homo sapiens
actttttaccctttttagcctttgcccttttttcgcctttattgtttggggttttaaggccaacaactatcaccctctcctactcttcttctccctgccccctggagggcactgtgtttggttgtgcaaatgtatttactatgcgtgtttccagcagttggcattaaagtgcctttttctaataaaatcagtttattatgac

SEQ ID NO: 321007 - DNA, 4032 bp, Homo sapiens
tgcgcctcgcccgcccggaccagcctgccccggcgccgaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgac

SEQ ID NO: 321008 - DNA, 4102 bp, Homo sapiens
gaattccctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtcgctcctgtggttggtccagcccagaatgcagccttgagcctggcttaggccaccacctactccagctctctccaccccctattttactgcagctcaggggcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaattttg

SEQ ID NO: 321009 - DNA, 3996 bp, Homo sapiens
tgcgcctcgcccgcccggaccagcctgccccggcgccgaggtcgctcctgtggttggtccagcccagaatgcagccttgagcctggcttaggccaccacctactccagctctctccaccccctattttactgcagctcagggggtaggctctaggctccaaagtacctggcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaattttg

SEQ ID NO: 321010 - DNA, 947 bp, Homo sapiens
tgctagccaccagaactcgtagtcgtgttcttgacttatttcctgctgttaagttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaattttg

SEQ ID NO: 321011 - DNA, 263 bp, Homo sapiens
cggcttccgaggggagaggacgggctggcggggctggggacccgcgtctcggcccccggagcggggaccacggagacagaccccggcccggcgaccgagctgggcccgtgagccactcggcctcaggtacgtcgatggcgccggttcttcgagccttgggggacgtggaaaagtttgcttgagggcggaatcgagagcgccggggccccggcgtggggctgggggcccagggaagggcgggagagtcgcggagtgtcgcgagc

SEQ ID NO: 321012 - DNA, 4165 bp, Homo sapiens
gaattccctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgac

SEQ ID NO: 321013 - DNA, 4226 bp, Homo sapiens
gaattccctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaattttg

SEQ ID NO: 321014 - DNA, 2700 bp, Homo sapiens
gaggagcactggggagatggaggtagaaggtctcccacccagctcccggctaactcccaactccctgcccctcttcctctagatactactaccaaagaggcatactgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaattttg

SEQ ID NO: 321015 - DNA, 955 bp, Homo sapiens
ccaaagtgctgggattacaggtgtgagccaccacgcctggccgccgaaataatttttaaagaatgtagtttagtaacaaggacatggaacccaaaaggaagaaattagatggaaaaatggtgagcaaattggtaaacatgtgaatctaaacaagcatttaatatgcaatatgaataataatgattaatttgtgggccacagaaacaagatgcatgagacacaagaacatggaagactgagagggcaatttgagagggggttaaagagactgagcattgtctggctttgtaaagtcaggtgtgtatttcagatatttaagaggatcaccaaaagaatacaaacggaactataactgccaatgcagagaaaagggtagtgatgggtattaaaactataatggaaggcagaaagggagaaaaaggaagcaaagtaaaagggatggtaaatatatagtacaaaaccagaggtagaaaatgtggtttacattcacctcttaaaacacagatgaccagattggccaagaaaaaataagatgcagctctatgctatttacaagaggaaatttaaaacctaagggcaccaaaaagtaaaacgatgggaaaaggtgtactagagaaaaactaaccaaaagatgtacctatagaaaactcagacaaaataggccttcaggcagaagacactggggataagaggatcaccatgaaatgatgcgaggaggaactctgtgaagagaggaaagttctgaacttctatgttccagggtttttgtttttaaggctgaaaataggccaggcgcagtggctcatgccagtaatcccagcactttgggaggccgaggtgggtggatcactagaggctgggaattcaagaccagcctggccaacatggcaaaactctgtctctactaaaaatacaaagattagctagctgggcgtggtggtgcacgcctgtcatc

SEQ ID NO: 321016 - DNA, 869 bp, Homo sapiens
cctttatagcgtcccccagttcccctgattacaggatccaattcaggatcatgcattgcatatagtttatatggttcttgagtctcctttaatctaaaaaaattctgtagccttttttcttccatgacattgactttttttttttttttttttttcccctgaggcaggaaaatcatttgaacctggaaggtggaggttgcgggagctgaaatcacaccatgttttccagccggggtgagtgagactctaactaaaaaaaacaaaaaaaaaaaaattggaatggggtgggccctaatttacaaagtgcattttttaagtgttggaggtgcgtgtggtttggacaacttatttttctctttgcggggctctcaaaaatttcaagaaaaggtttgttttgattgtgcctgtgaacaatttccacacatttaaggggtataggggcagtggtggtgtttcataaaaaacaaagggggtatattatgaatgcccaaaggtaaatacctgtccaacaaaataagaatggcaccatctgcccgggggaataagttcggacaacggcgtttaaacataaataagggtgaaacacctctctggggtcacacaatatacctcccaattgacagaccgctcggagaaggaatggtggttcctctaggaaacaaatgggtccccatctcgcggggcttaaaaaaaaaattagttgcctctccggaaaaaacgacagcaccggacaccaagcgaacagcacagagacgcagcaggcaacacgaaacaacaacagaagtagcacaaagacgcgacagcccaacgtcatacgcggcggcgacatcactacacaagcacgacgaccggcgactcgaagagacgcc

SEQ ID NO: 321017 - DNA, 465 bp, Homo sapiens
caatatggaataaaaattcgggtttactataattttttaattactgtaattcttatttatagaagtttctaatcattctttttcattatcccttattttaatggaaattatttgttaaatgactaaaattaaaataatttaaaagatccagtggacgcagatgggaaatggtgatagctgtctttcctggtgagttaaagattacaagaaaattaacaattttcatacgacatttaaccacctcgctcccctgtggtctacaccattctagtgagttggtaggaattgtaggataagctgtcttattctagtgtttaagaagaaatcaagcggcagggcacagtggttcatgtctataatcccagcactttgggaggctgaagcgggaggatcacttgaagctgagtttgagaccagcctgggtagcatagcaagacctcatctctgtttaaaaaaaaaaaaaac

SEQ ID NO: 321018 - DNA, 602 bp, Homo sapiens
gctttctcctttgaaatgtaggtcctcgagaacattcatttctacttatgatgaaattgtgaaaactagtaaatctgatccagggtgtagtttttatcagttgcctctcaccccttaaaaaaaaaaattaacgtgggaaaaatattgtcatggattttctatctgtactcacagcttgaccagatggttttaacattgtggaatgcctagcagtttaaagccattaactagcctctggttaccctcttctggatttctagtttttttcttaaggtcatcatgtattgcttaagctctgtctttgtgagaaagcttgtccctgctggctttaaaactttactatgctggggaaaattttggactaaagtgacattcacattatactgacctcatcgcccaaatgatgaatgaatgaactaatgtacactacaagaacatgtcttaataggaaagtagactgttgtctgtagttgtcccattgttttatcattgctgctactatattgacatgaagtagcagtgggtgtgcatgtttgtatattttttctgtgctgttaaataagtccacgcacatctcccatgtgggtagggtagtactgggt

SEQ ID NO: 321019 - DNA, 2612 bp, Homo sapiens
  misc_feature (2)..(3): n is a, c, g, or t
anngtcagtacatttcagtcacccccgcccagccctcctgatcctcctgtcattcctcacatcctgtcattgtcagagattttacagatatagagctgaatcatttcctgccatctcttttaacacacaggcctcccagatctttctaacccaggacctacttggaaaggcatgctgggtctcttccacagactttaagctctccctacaccagaatttaggtgagtgctttgaggacatgaagctattcctcccaccaccagtagccttgggctggcccacgccaactgtggagctggagcgggagggaggagtacagacatggaattttaattctgtaatccagggcttcagttatgtacaacatccatgccatttgatgattccaccactccttttccatctcccagaagcctgctttttaatgcccgcttaatattatcagagccgagcctggaatcaaactgcctctttcaaaacctgccactatatcctggctttgtgacctcagccaagttgcttgactattctcagtctcagtttctgcacctgtcaaatagggtttatgttaacctaactttcagggctgtcaggattaaatgagcatgaaccacataaaatgtttggtgtatagtaagtgtacagtaaatacttccattatcagtccctgcaattctatttttcttccttctctacacagcccctgtctggctttaaaatgtcctgccctgctttttatgagtggatacccccagccctatgtggattagcaagttaagtaatgacactcagagacagttccatctttgtccataacttgctctgtgatccagtgtgcatcactcaaacagactatctcttttctcctacaaaacagacagctgcctctcagataatgttgggggcataggaggaatgggaagcccgctaagagaacagaagtcaaaaacagttgggttctagatgggaggaggtgtgcgtgcacatgtatgtttgtgtttcaggtcttggaatctcagcaggtcagtcacattgcagtgtgtcgcttcacctggctccctcttttaaagattttccttccctctttccaactccctgggtcctggatcctccaacagtgtcagggttagatgccttttatgggccacttgcattagtgtcctgatagaggcttaatcactgctcagaaactgccttctgcccactggcaaagggaggcaggggaaatacatgattctaattaatggtccaggcagagaggacactcagaatttcaggactgaagagtatacatgtgtgtgatggtaaatgggcaaaaatcatcccttggcttctcatgcataatgcatgggcacacagactcaaaccctctctcacacacatacacatatacattgttattccacacacaaggcataatcccagtgtccagtgcacatgcatacacgcacacattcccttcctaggccactgtattgctttcctagggcatcttcttataagacaccagtcgtataaggagcccaccccactcatctgagcttatcaaccaattacattaggaaagactgtatttcctagtaaggtcacattcagtagtactgagggttgggacttcaacacagctttttgggggatcataattcaacccatgacagccactgagattattatatctccagagaataaatgtgtggagttaaaaggaagatacatgtggtacaaggggtggtaaggcaagggtaaaaggggagggaggggattgaactagacacacacagacacatgagcaggactttggggagtgtgttttatatctgtcagatgcctagaacagcacctgaaatatgggactcaatcattttagtccccttctttctataagtgtgtgtgtgcggatatgtgtgctagatgttcttgctgtgttaggaggtgataaacatttgtccatgttatataggtggaaagggtcagactactaaattgtgaagacatcatctgtctgcatttattgagaatgtgaatatgaaacaagctgcaagtattctataaatgttcactgttattagatattgtatgtctttgtgtccttttattcatgaattcttgcacattatgaagaaagagtccatgtggtcagtgtcttacccggtgtagggtaaatgcacctgatagcaataacttaagcacacctttataatgaccctatatggcagatgctcctgaatgtgtgtttcgagctagaaaatccgggagtggccaatcggagattcgtttcttatctataatagacatctgagcccctggcccatcccatgaaacccaggctgtagagaggattgaggccttaagttttgggttaaatgacagttgccaggtgtcgctcattagggaaaggggttaagtgaaaatgctgtataaactgcatgatgtttgcaggcagttgtggttttcctgcccagcctgccaccaccgggccatgcggatatgttgtccagcccaacaccacaggaccatttctgtatgtaagacaattctatccagcccgccacctctggactccctcccctgtatgtaagccctcaataaaaccccacgtctcttttgctggc

SEQ ID NO: 321020 - DNA, 4283 bp, Homo sapiens
atcaaaggtgtcaggaccgaggggactgtctgatttagtaagatgggtcactcgtggccaggcccaaaggccccgccttctattcttgtgctgctcaaacccaaaggccctcttgctgttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaa

SEQ ID NO: 321021 - DNA, 4299 bp, Homo sapiens
  misc_feature (4)..(4): n is a, c, g, or t
  misc_feature (7)..(9): n is a, c, g, or t
ggcncgnnnccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactgtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaa

SEQ ID NO: 321022 - DNA, 4159 bp, Homo sapiens
  misc_feature (4)..(4): n is a, c, g, or t
  misc_feature (7)..(9): n is a, c, g, or t
ggcncgnnnccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggcgccagggtcagggcgaggcccaggggtggacaggggccgtgtagcatgccccagcctccccaagctcctgctgtatgtcgtccatgtcacgccaattaaacacgcttcctggacttgtcctcgcctccctgtgtg

SEQ ID NO: 321023 - DNA, 4396 bp, Homo sapiens
  misc_feature (4)..(4): n is a, c, g, or t
  misc_feature (7)..(9): n is a, c, g, or t
ggcncgnnnccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggtgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaacagctggtcccatcttctgtcttggcatcttagcatccaggctcaggctctgccccttctccaggatggggtagccccgagtcgccctccccagtctgcacattccctgttgtccctgttcctgcagtggctcccggccccagggaggcccacctcactcccagcctgactcggtggctggcttccttcaggactttgcgcaagtcagttctgctcattgggtctcaatttccccatcccttggatgggagcaagagtctctgctgggcctgccttgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggcgccagggtcagggcgaggcccaggggtggacaggggccgtgtagcatgccccagcctccccaagctcctgctgtatgtcgtccatgtcacgccaattaaacacgcttcctggacttgtcctcgcctccctgtgtg

SEQ ID NO: 321024 - DNA, 1110 bp, Homo sapiens
cggctaggtggaggctgggtgccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaa

SEQ ID NO: 321025 - DNA, 4324 bp, Homo sapiens
  misc_feature (4)..(4): n is a, c, g, or t
  misc_feature (7)..(9): n is a, c, g, or t
ggcncgnnnccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaa

SEQ ID NO: 321026 - DNA, 5011 bp, Homo sapiens
  misc_feature (4)..(4): n is a, c, g, or t
  misc_feature (7)..(9): n is a, c, g, or t
ggcncgnnnccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaacagctggtcccatcttctgtcttggcatcttagcatccaggctcaggctctgccccttctccaggatggggtagccccgagtcgccctccccagtctgcacattccctgttgtccctgttcctgcagtggctcccggccccagggaggcccacctcactcccagcctgactcggtggctggcttccttcaggactttgcgcaagtcagttctgctcattgggtctcaatttccccatcccttggatgggagcaagagtctctgctgggcctgccttgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggcgccagggtcagggcgaggcccaggggtggacaggggccgtgtagcatgccccagcctccccaagctcctgctgtatgtcgtccatgtcacgccaattaaacacgcttcctggacttgtcctcgcctccctgtgtg

SEQ ID NO: 321027 - DNA, 4093 bp, Homo sapiens
  misc_feature (4)..(4): n is a, c, g, or t
  misc_feature (7)..(9): n is a, c, g, or t
ggcncgnnnccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagctgtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgcccctgtgtgtagcgccacgccctggggtgaccacggcgtgtcgggcgtgccggggccgaggtgtatccaaggcgc

SEQ ID NO: 321028 - DNA, 1773 bp, Homo sapiens
gatgccgcagaatcctgagccaggtgcctcctgagcagcccgtgcgcctctccacagcggcgttgccacccaatgcggctcgcttcagatgctctgatgcagagggcatgcccatagtccctctgcagagcctcgcactggggccaggcaggcaccagccccaggcggccagtcggccacggctgtcctcttcctcgtagcgtctgctcctcactttgtgttgatggtgacttaggagaatgttccgattttccatgatctaagcaggccacgtttaaaacaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtctggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcatgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcctcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctctttttttttttttttttaatatctgcggaataaacccaatggttaatttttgaatgaataaaaggcttttgttgaataaa

SEQ ID NO: 321029 - DNA, 657 bp, Homo sapiens
tatatttacccttaggaatagaagtgaccgaagaatccggattgaaaccagcatcctatatacagctccacaggatgtgcttctcttcatggtaattttccatatatatcatctactttgatttctgccccgttttaatgtccatataaatgtttcagtccaatttgtaagtgttgagtccactgatgtagaagttctgacttgtaaaccattcatcctgctttagtcatatgatagtaccgatgcaattagctcctctcccaccaccgtgggggatttctccctgagatgaggtgtgctttgaccagctgcatgtggcttgattgcattcctgtttctcttagttccactggatcttgttttcttttatttcgttatattacctgagctcagggtagttccgttcatctttagaaagagctcatctcttccatccttagaaggatctcatcagagaactcatatgtaatcaatcaggtaaaagaaatactgatgtacttctgagagactggtgagaggtgggtcataggaagcccataggtctgaggaccgagtcagtgtcttggggatggggctgttccatatgattatttttgtgtggcataaaagatgtaaaaaaaaaaaatggtcctttacatgcaaagaccctagcttcct

SEQ ID NO: 321030 - DNA, 303 bp, Homo sapiens
tcttctttatatattcaaacaatataccacagtgttactatatccatatccacaaaataggagattttgtatatatattattagatttatacataagtatttcaatatggggggtgctaatataatggtagtatgttttaatttccacttgttcattgctggcatatagaaagcaaatgacttttgtatattaaccttgtatcctgcaatgttgctataattaattgcttattagttccagtggttattttgtagatacttttggattttctatatagacgatcatgtcatcagccaacaaca

SEQ ID NO: 321031 - DNA, 8492 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggtcagtgctaggggcggggcggccggcgggtggcccgtggccccccgagcttctaacggggagcaggtcgtccctcccacagggctcgagtccccggggccgagccgtttctcgttggctggcaatggggggctcacaattgcctgttgcattctgaaggacgtttctcaagttttttttttttgcctggtcccggaaggaaggttttgttatgatcataaaactggatttcatgttgcagtcatttcgtcaggcaacttccgccgttgaccaatttgttgtcctcaggctggaatcgggcaagagaaagtcccgctggtatttagacagtttctaaaacaaaagcacattttcaggccgggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321032 - DNA, 7927 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321033 - DNA, 8272 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaagatggagtctcgcttttttgccaggctggggtgtagtggtgcaatcttggctcactgcaacctccacctctcaggttcaagtgattctcctgcctcagcctcccgagtagctgggactacaggcgtgtgccaccacgcccaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321034 - DNA, 8238 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcgggtaagagctggcgggcgggcgggatgtgggggcgccttcttgctggggaaatccggattacaggctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321035 - DNA, 8026 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321036 - DNA, 4276 bp, Homo sapiens
acaaagcaagataaagagttaggacctaagacttaaattaaaacatctcatatataaaaatattaaacccagccctgaattaatctaggagtactcataatctgataattaacccagattagtttattttgagcctctgaatttaacttgacaagtaagaatttttcagacttaaaaatttttttttttaatttttcagaatagaggtataatttaattacttttttttttgagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321037 - DNA, 7398 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcgggtaagagctggcgggcgggcgggatgtgggggcgccttcttgctggggaaatccggattacaggctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgaggaggtaagtattaagtactctattatctttgtagtgatttcccttcaggggggctgtatgtgactcttcaagtatattatggtaattttgggtggggaaaacatgctgtttgtgtgaagctgaggaaaggatcttcacagcccatgattctacgaagctcccctttttcatcttttctgatactttatttcatttctaattagttgatctatggctacagaagaatgttaatacgggtgccactcctttttaagaacagttttcagtgtttattaaacatgatgctgcctttggggaacatctcaatgatgtatgtattacctttggagaatacgtgataga

SEQ ID NO: 321038 - DNA, 5810 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaattttta

SEQ ID NO: 321039 - DNA, 5661 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacatgccctttttccctccatcatttgtgtaaactgattaatcagtttacacaaggcaaaaactatcgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaagaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgactcatgtacatgttgataatatgctgtttattatacatttagtgttcaagagattcacgtaattgctttttg

SEQ ID NO: 321040 - DNA, 4229 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctcttttttttttttgaaacagagctttgctttgttgtccaggctgggttgcagtgagccaagatcgcaccactgcactccagcctgggtgacagagtgagactctcaaaaaaaaagtaaccagcattctgacttctgtcacccacaggtcagttcatattattgaatttgaagtatgtctcttttaaatttatagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321041 - DNA, 1674 bp, Homo sapiens
gttgacccttgtatgtaaagctattatcgtggcattagagaaggaagaagtgtaattgaacacttatgtttcactaaaatgtgtttctttccattttatcaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctcttttttttttttgaaacagagctttgctttgttgtccaggctgggttgcagtgagccaagatcgcaccactgcactccagcctgggtgacagagtgagactctcaaaaaaaaagtaaccagcattctgacttctgtcacccacaggtcagttcatattattgaatttgaagtatgtctcttttaaatttatagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321042 - DNA, 1133 bp, Homo sapiens
gtctgctggaaggactactttggtttaatgagaaagcaggtatatgactgcctcagaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321043 - DNA, 3958 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttgtaagtcttttataatttcgggaacaagtgttctgttttttaaaatattattttcaatgtttaacaacctgttatcttaaaaatgtaattgaatggctgttcctaggtgttttgtttgcagtaatatactatttctaaaactggggggggaaatgtcagccttttgataaaatctggtttatgccttatcttggtactacttatttatgtgtctacttttgatccctcctagaataatacaaaaaggtgtgagaaagtgagaacttaataggtagctgaatgg

SEQ ID NO: 321044 - DNA, 3121 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctcttttttttttttgaaacagagctttgctttgttgtccaggctgggttgcagtgagccgagatcacgccattattctccagcctgggtgacaaagtgggactccatttcaaaaaaaatacaaaaattagccaggcgtggtgatatgtgcagtcccagctacttgggaggctgaggtgggaggatcacttgagcccgcaacatggaagttgcaataagttgagattgcgccactgcactccaacctgggccacagagcaagaccctgtc

SEQ ID NO: 321045 - DNA, 443 bp, Homo sapiens
atgtgccacgacgcccagctaatttttttgtatttttagtagagattgggtttcactaggttggccaggcttgtgtcgaactcctggcctcaagtgctctgccacctcagcctcccaaagtgctgggattacaggtgtgagccaccacacccggcctatgttgtgtcttttgaagcacatatattttaattttgataatgtccaatgcatctgttctttcttcagttgcttgttaggtgtcagcaaagaaccatctataaacatgcatggttgttcacttgaattgcatgtagccactgttatactaggcatactaggcattatgaggcatattaggcattattaaatacccagtaaatagtttgtggtaaatcaatcttttaagtttcctttttttttgttatagaaatttccatcgtgaagcctttaatcatcttacccaa

SEQ ID NO: 321046 - DNA, 353 bp, Homo sapiens
tatgaacacttttattaatactacaatggttctgctgtgattgagcaggagcgagttcagaagacctttcctcacccaattgataaatgggccattgctgatgcacaatctgctatagaaaaacgaaaacgaagaaatcctcttttactgcctgtggacaaaatccatccttcgttgaaggtaacaaaagattaaacattagttggggggtgttctttataacaagtaatattttatttctatatttataaagcattaatgtagcatggtctgtgttagtgtgtatatgtgcacttccatatgtatgcttgtacatacacatcgcatatattaatatgtatacaaaatgatta

SEQ ID NO: 321047 - DNA, 473 bp, Homo sapiens
gaatcctttttctggaaaccaaaatcagtacatggtttagttaacaggagcttacccaatcattagttacagaggggtttttgtttgtttgtttttgttttaagataggggtcttgctctgtcacacatgttgtagtgcagtggagtgatcatagctcactgtaacctcgagctcctgaggctcaagtaatcctcccattcagcctcctcaatagctgggactataggtgtgcaccagcatgctggctaatttttaaattttttgtaaggtgttgcggggggtggtttgtctctcgctgtattctccaggctggtcttcaactcctgctttcaagcgatctttccacctctgccttccaaagtgttgatattacaggtgtgagccactgcacctagcctagagctttaattacatgtgctttgttggattgattcaaagatggataaattgtaggggagctataaatacccct

SEQ ID NO: 321048 - DNA, 8131 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321049 - DNA, 8190 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaagaagtgtaaagcatggttctcttccattgtcctcttgatgtcctgttacagcatttatgggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321050 - DNA, 8960 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcgggtaagagctggcgggcgggcgggatgtgggggcgccttcttgctggggaaatccggattacaggctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggtactgaaatggtttgtatggcctttcagcttgttttaagatattgatttgtagtttgttttgaattgcgtttcattaaaaggatggaaggggactttccggttctttataaaacaagagtattttgaattattaaaacaattgaaatatttgtttggcatttttaaggggggaagaaatagaaggctttccttctccacccgacttcatactgatggccgactgcatatactatgaagaggtaagtatccagtgagcgaagtctcttcacttagaagatgaaccttattccatgaattctaaagcacacgtttcttcacattttaacatctttgaatccgggatttgccttatagttgatgcagtaaagagaagataaaagtcaccagggaccatatgtatatacgctcatcattatcataccgacctggtgaagcatgttgagaaaagtgttatatgcattttactagaggcttctgtaaaaattttaaaggattttgccaattggatgttatgaaaagccaaaatcctctctttttcccttggttgttcccacggaacatgttaaccatgacattgagaattaagttataaataattcattgttcttttctttaaataccagtttgggccactgcacctagcctagagctttaattacatgtgctttgttggattgattcaaagatggataaattgtaggggagctataaatacccctgtacctcctcaacctacttttagagtagaaaaatttttaaatcaaaaacaaaaaatatattcttttttaaatagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321051 - DNA, 8406 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcgggtaagagctggcgggcgggcgggatgtgggggcgccttcttgctggggaaatccggattacaggctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggtactgaaatggtttgtatggcctttcagcttgttttaagatattgatttgtagtttgttttgaattgcgtttcattaaaaggatggaaggggactttccggttctttataaaacaagagtattttgaattattaaaacaattgaaatatttgtttggcatttttaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagctccttcagctagattttgactttgaaaaaattcctttggaaaaacatgatgaagagtatcgaagtgaagatattcatattatatacatcagaaagaaaaaatcgaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgaga

SEQ ID NO: 321052 - DNA, 8120 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaaatatgtgttttcattataaggaacaaagggggagattgttgagtcctatagacacacacacacacacacacaattttttcttcactgttaaatgtgagctgcaggcttctagcaaccacttttatgaattcatacaaaaaactaggagcatactaggaacttgaaaaggaagattgtaagattatagccatctttggtaggatcttggaagctgattgcatttaagccttgtaactactatgtaaatcaagtgtccaacttggtaaactctgaggttggctttgttttttaaagagcagattataatagttttgtctgggaaagtgatttaaacggcctcttcgttaagccaaacgtgtgatttagggtagagggaggctgccaagcgcgtcgggtaagcaggggccccacgctcggccccgcccaggtaacgctgccttccgggctttgttaactcgcgcgcgctgcgtcgccaactcagcggcgggcagggggcggagccgcagggcggggcggtgcgcgttgatgtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcgggtaagagctggcgggcgggcgggatgtgggggcgccttcttgctggggaaatccggattacaggctttcccccctgtgcctacacctcagtcgacgttattttatagggctgatgttgtagtcaccgatcttgaggaattgcaagacttgctgaagatgaatattaatatgaacaagcatcttgtcactggttctgttcaagccaaggtactgaaatggtttgtatggcctttcagcttgttttaagatattgatttgtagtttgttttgaattgcgtttcattaaaaggatggaaggggactttccggttctttataaaacaagagtattttgaattattaaaacaattgaaatatttgtttggcatttttaaggggggaagaaatagaaggctttccttctccacccgacttcatactgatggccgactgcatatactatgaagaggtaagtatccagtgagcgaagtctcttcacttagaagatgaaccttattccatgaattctaaagcacacgtttcttcacattttaacatctttgaatccgggatttgccttatagttgatgcagtaaagagaagataaaagtcaccagggaccatatgtatatacgctcatcattatcataccgacctggtgaagcatgttgagaaaagtgttatatgcattttactagaggcttctgtaaaaattttaaaggattttgccaattggatgttatgaaaagccaaaatcctctctttttcccttggttgttcccacggaacatgttaaccatgacattgagaattaagttataaataattcattgttcttttctttaaataccagtttgggccactgcacctagcctagagctttaattacatgtgctttgttggattgattcaaagatggataaattgtaggggagctataaatacccctgtacctcctcaacctacttttagagtagaaaaatttttaaatcaaaaacaaaaaatatattcttttttaaatagtctttggagccattgctgaaaactctaaaagatatcagcggatttgaaacttgtattatatgttgttatgaacaacgaacaatggggaaaaatccagaaattgagaaaaaatattttgaggaggtaagtattaagtactctattatctttgtagtgatttcccttcaggggggctgtatgtgactcttcaagtatattatggtaattttgggtggggaaaacatgctgtttgtgtgaagctgaggaaaggatcttcacagcccatgattctacgaagctcccctttttcatcttttctgatactttatttcatttctaattagttgatctatggctacagaagaatgttaatacgggtgccactcctttttaagaacagttttcagtgtttattaaacatgatgctgcctttggggaacatctcaatgatgtatgtattacctttggagaatacgtgataga

SEQ ID NO: 321053 - DNA, 5615 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcag

SEQ ID NO: 321054 - DNA, 4914 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggcccgttttaggaatgcatatgtcggatctgttttacactgtcgtgatttggttaaccgtgctcgatatatattcttttat

SEQ ID NO: 321055 - DNA, 4121 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaaggtaatcaacaggactttactccaacttattca

SEQ ID NO: 321056 - DNA, 2864 bp, Homo sapiens
cactctgcgctgctgctaaaggggcagcaacggcggccagcgctgtgcgcgccatagcgaggctcgctcgcccgacgcgcactccgggtcggtccccagagctctgtggaggtgactcgagtgggcagggccgggcggcgctgtcggctgggagggcggggaggaggcgatgaggagacgagcagccgccgccgccgccgccgctgctcaccgcccgccgcggccgtagcgggagtcggggcggggctgggccagctgtacccctgacgggccgcgaacccagacaaaggaggaggagccgccccagaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggtttggcttgaatattttttatatatatatatatacacatatatatacacacacacacacattttatgtgtcagttttcaatatatagttaacacaaaagctctcagcttttaattcaaatatagggaatatttttaacttcacagcagttaagttaaactaaaagagttctttctcagtgaagctattcttaaataccctgaagaa

SEQ ID NO: 321057 - DNA, 982 bp, Homo sapiens
ggctctgataggcccactcctcttctccacccaggagatgagaaggagggcaggcctttttaatctgatcagaatgttaacccatctctccgccttgcggtagaacccctggatacattatttgccctctcgaaaggcaggctctgaatttgattcaggtatatttcttcatagctaaccagcacaatggaaaactcagggaaagcaaataaaaaggatacacatgacgggccaccaaaagaaattaaactgcctaccagtgaagcacttctagactatcaatgtcaaataaaggaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagagaggttgcaattcacaggaaggaagttgaagaattaaaaaatgctattcatgaactggaagcagaaaatttggtgcttattgatcaactatccaactgtagacttgtggatctcaagatacccag

SEQ ID NO: 321058 - DNA, 1941 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321059 - DNA, 1981 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagtaggtgtcagctgtgtctgaatgagataattggccccagtc

SEQ ID NO: 321060 - DNA, 2608 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccaggtaggaccctgaagattggaagctcccaccgggagtgtcacgcggacacccccgaggctgagtgtggggtctgcagcagcgtgaccgtggacacccggggaccgagtgtgggatgcggcggtacccggccccctgacatccggggccacccaccgggagtgaggggacctggccctcacgtcactgaccccgcagcgtccttgcctgtgttctgcttgggagtgctggggttggatccagtactggagggaggaggctgcgagcaggggcctagctccctccctccccggaggctgtcacacgccgctaaggcctggctcacggacgcccccgcctcctgagctggggatcccaccctagttcagccctacgacacaccagtggtcggagctggcttctgaaccggggttccaggcacacaagcacacagccaagcgtcagtcatcatctggtgggagacagggcgtctcggagtcttcccaccccgacctttgcaggcctgggactgggtctagtttctgaagccccatcacccactttaccttccacccccagtcgtggagcagagagggcttcttttcaaattcgtttatgagctctacccacccggatgtgagaggctccaggcctagcctgtttgctgtgaggacactgaggaatagtgaggaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321061 - DNA, 2050 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccaggtcccgaatgcccctccccatcctctgtggtgaagttgccctggcttgggccctggaggccttcctgcaggggtggatccgggaggaagatagcaggactggagcaaagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321062 - DNA, 1962 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagagccctgtgttccttggccagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321063 - DNA, 1514 bp, Homo sapiens
agtgagctgagatcacgccatcgcactccagcctgggcagaggtttcagtgagccagaatcacaccactgcactccagcctggatgacagaacaaaaattcgtctccaaaaaaattttttttttcatagagacaatgtcttcctttgctgcctaggctctagtctcaaactcctgggtcaagtgatctttctgccttggcctcgcaaagtgttgggattgcagacctgagccacagtgtccaacctgtctaatttttggtgtctaagctttgtactgcttcagatccaggtagaatgtgggcttcctgggttctcagcactaagtgagggctaagtggaggtcccagacatgttgaaagccagaatgctatgcttcccctctccccccatagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321064 - DNA, 1849 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321065 - DNA, 2235 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagtcgtggagcagagagggcttcttttcaaattcgtttatgagctctacccacccggatgtgagaggctccaggcctagcctgtttgctgtgaggacactgaggaatagtgaggaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcggtgaggtcccaccagcctggtctccagaacctggggcctgagggaggagaagtgtgggtccctcagagggaacctggagatacttgggcccctgattttttgcggggagtgtggattcttgtcccctttgaagtcctaggaggctggggtcccaggtggggctagatttgaattcagggccgttctggttctctctggctccccgccctccctcaccaccagtggaaccttcatcgagttccggaatggcatgctgaacatctcgcccatcggccggagctgcaccctggaggagaggatcgagttctccgaactggacaagaaagagaagatccgggagaagttcgtggaagccctggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321066 - DNA, 1875 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctgacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321067 - DNA, 1887 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321068 - DNA, 1944 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggcctattaagcagacgtgtcacatataatttcatttttttttttttcttttttc

SEQ ID NO: 321069 - DNA, 2163 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcggtgaggtcccaccagcctggtctccagaacctggggcctgagggaggagaagtgtgggtccctcagagggaacctggagatacttgggcccctgattttttgcggggagtgtggattcttgtcccctttgaagtcctaggaggctggggtcccaggtggggctagatttgaattcagggccgttctggttctctctggctccccgccctccctcaccaccagtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321070 - DNA, 2275 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagtcgtggagcagagagggcttcttttcaaattcgtttatgagctctacccacccggatgtgagaggctccaggcctagcctgtttgctgtgaggacactgaggaatagtgaggaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcggtgaggtcccaccagcctggtctccagaacctggggcctgagggaggagaagtgtgggtccctcagagggaacctggagatacttgggcccctgattttttgcggggagtgtggattcttgtcccctttgaagtcctaggaggctggggtcccaggtggggctagatttgaattcagggccgttctggttctctctggctccccgccctccctcaccaccagtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321071 - DNA, 1901 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321072 - DNA, 2285 bp, Homo sapiens
aaacaactgtgtactaggtacgatactcgttgtgatttcatcacgaggagattgctggcatggtacatcacgcctggctaattttgtatttttagtagagacgaggtttctctatgttggtcaggctggtctcgaactcccgacctccggtgatccgcccgcctcgacgtcccaaactgctgggattacaggcgtgaaccaccgcgcccggctcaggagatttcctacagctcaaaatttgtaaggcaaagagatggccacaaaccttgtgagagtggatggggagcgacctcggctctcttagtcccgcctggcccactagacactgcactgcatggtagaggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcagggccccgcccccgcttccgcccgcctagaccacgccccttcttcatttggccaatcaggcagtccactggcccccgccccctaatgccccgccccgtcagcacttatccctgagctgcttctgccgtagcggatcttcgggactccgccccgcgcgcggacctgcagccatggcagtcaccgcccaggcagcccgcaggaaggagcgcgtcctctgcctgtttgacgtggacgggaccctcacgccggctcgccaggtaggaccctgaagattggaagctcccaccgggagtgtcacgcggacacccccgaggctgagtgtggggtctgcagcagcgtgaccgtggacacccggggaccgagtgtgggatgcggcggtacccggccccctgacatccggggccacccaccgggagtgaggggacctggccctcacgtcactgaccccgcagcgtccttgcctgtgttctgcttgggagtgctggggttggatccagtactggagggaggaggctgcgagcaggggcctagctccctccctccccggaggctgtcacacgccgctaaggcctggctcacggacgcccccgcctcctgagctggggatcccaccctagttcagccctacgacacaccagtggtcggagctggcttctgaaccggggttccaggcacacaagcacacagccaagcgtcagtcatcatctggtgggagacagggcgtctcggagtcttcccaccccgacctttgcaggcctgggactgggtctagtttctgaagccccatcacccactttaccttccacccccagtcgtggagcagagagggcttcttttcaaattcgtttatgagctctacccacccggatgtgagaggctccaggcctagcctgtttgctgtgaggacactgaggaatagtgaggaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcggtgaggtcccaccagcctggtctccagaacctggggcctgagggaggagaagtgtgggtccctcagagggaacctggagatacttgggcccctgattttttgcggggagtgtggattcttgtcccctttgaagtcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagt

SEQ ID NO: 321073 - DNA, 4034 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgactta

SEQ ID NO: 321074 - DNA, 4042 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321075 - DNA, 3883 bp, Homo sapiens
tgtgttggacatgccattcacgaagcatcaattttcatcttccttttttattttgacttagaatcaagttttggggatttgaaggccagatgtttacaagaatttctgaactttctctactagactgtggtggtgttcattgatttatattattgaattgcaagtttttcattattactgttgtgaagcaggtacagtggcattcctgagacagatactttcatgctcaactctttagctgcaacgaaagctatgtagtggttaatgaatataaaggaattctagtatgtttatatcataaagttgaaagataactgaactaggaattgttagaagaggattctagtctagtgtctgtctctttgaggtttataaccttagggagacaaattgcttaactattctgttcttgttttccttatgtataaagtaaaggagttgggcttgcaaaatctctgccagttctaaaattctgtgatttttgaagtaatttaaaaatgtctcataaattttgtactccactaaacattctctttcttctctatagggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321076 - DNA, 3992 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagaccagttgattaatattatggatttgggaaaagtttagcgcgaaataattttaaaggccgaggggtgaattggtttctacaaagactgctttt

SEQ ID NO: 321077 - DNA, 4065 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccagttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321078 - DNA, 3884 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaaaactaggaacataatatgttttatgataaacaataatactaaatctgagttgtatgaactgttaacttgaaatttgttttagag

SEQ ID NO: 321079 - DNA, 2526 bp, Homo sapiens
tctcaaactcctgacctcaggtgatccacccaccttggcctcccaaagtgctgagattacaggcatgagccaccacacctagcctatatatggaatttcttatgggaactcttatgtgaagtattaatgtatgtcaaattcaaattgcaaaatgtactagatattttcaatccttagcctccttaacaaagatttcagcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321080 - DNA, 1973 bp, Homo sapiens
cccacgcgtccggcccacgcgtccatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321081 - DNA, 1897 bp, Homo sapiens
agatgaaatgtgattgcaaaagtgctgccaaagtaattgaatgaagaaaattacatatttgaatcttctacttcaaaaatgaaaaactgaagtttcccgttggcttttaaaatgttatgtctgtctaacaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321082 - DNA, 1895 bp, Homo sapiens
tttctcaggtgtgctgatttagttatcactgttacttgctttctcaaaattccccaattatattgctctcttctcttactgttcttgtttttgtaggtttcttcctctctccctcccatccttcctttctttcttccttctcccctcccttcctgtcttttatgattttttttttttttgcatgggatttcaggagggagcagaggtaaatgaatgtgttgaattttccatcttgaacccaaaattcaagaatagttctttagagttagattttaaaactaggaggttgtaaatcatttttttaaatgtctccctgtaaatatttccttgatgaaattaataccatttaatgttatgactcaactatttttgtctcttaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321083 - DNA, 2362 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcaggtggtgtgctcattctcaaccccctgacaaaacacatagcctaccccttccttgtactatccctatgaggcataattatatcaagctccatctgcctacgacaaacagacctaaaatcgctcattgcatactcttcaatcagccacatagccctcgtagtaacagccattct

SEQ ID NO: 321084 - DNA, 1517 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgtccggacagcacgcgctaacaatagacataatttacttcattatgtctatcgttcattgtctgtcttttccaaattctactggctcttaccctctccagaattgaaactagtatcttgtttttgttactgatgtac

SEQ ID NO: 321085 - DNA, 607 bp, Homo sapiens
gttaaatgttgaatgtgacatgaacagattttcacaatattaaatacgtctttttcctctaggttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaa

SEQ ID NO: 321086 - DNA, 298 bp, Homo sapiens
cctgaattttggcacttaaaaagtgggatataagattttttttcatgtatacatatgtaactaacctgcacaatgtgcacatgtaccctaaaacttaaagtataataaaaaaaaaacaaaaaaaaaagattttttttctattgaaaacatattttccttcttgacttaatttctctaaatgttctttttctttcttccccttaacagaccataaatactgtatcagaagttattcgaggctgccaagtaaaccaagactactttgcatctgtaaatgcaccttcaaacccaccaaggt

SEQ ID NO: 321087 - DNA, 616 bp, Homo sapiens
tgggatataagattttttttcatgtatacatatgtaactaacctgcacaatgtgcacatgtaccctaaaacttaaagtataataaaaaaaaaacaaaaaaaaaagattttttttctattgaaaacatattttccttcttgacttaatttctctaaatgttctttttctttcttccccttaacagaccataaatactgtatcagaagttattcgaggctgccaagtaaaccaagactactttgcatctgtaaatgcaccttcaaacccaccaaggtagaaaaagggaaatactgagattactctgaggaagtaaaaactttgggttgttaatgtatctcatatacacatcttactctttttaaagaagtttagttgtatgttttggaactagaaattatctgacaagataaatgatattgatattttaaaagagttggtagtctttggaatttagatacttagattcagatatcatgtcgtccacatcctagctgtatgccttaagcaagcagtcacttcacttctgtcagttacagttttctgtgaaatagagatggaaatacttaacttgctggtgttctggttatgattcttcaatcaacaaaaatgactagtt

SEQ ID NO: 321088 - DNA, 402 bp, Homo sapiens
gagtttgatttccatgtccgctggcctggtgtgaagcttcttacttctcttttaaaacaactagggcctcaggtgcaacaaattattttagtcagtcctatgggtaagtgacttatcttttttatattattttgattcaagcatgagtatcatttcctagagaaagggactgaaatggtgtgttagtaaattgttaataatttgagtcactatttgtatttttggtctgccagcatttttcacatggttgtatgttctaggtgtttcaagattgatggacttactagcggattccagggaagttatacgtaatgatgtaagttaaatttcaaaaagaaatacaaaaatatgtggcttttttttctcttgcaaatgaaatccttgttgttgagttttaggaaa

SEQ ID NO: 321089 - DNA, 4119 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321090 - DNA, 4140 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggtgataagatcgacagacggggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321091 - DNA, 4041 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacactgataacacctcaccaccacaacaacaaaacactcacaccaaacaccaacacataacaaaccaaccaacaacacaaaacaaatcaactaaaaaaactcaaccacacaccacaacacaaataacaacacacaacacacaacaaaacaaccctcttatgttcctagttttaaaaagacccaaagtataacttttacaaaaaaacaacacacaaaacacaaacacacaaaaaaaactccacaaacaaccaccaacacgcaaatgaggcaatgtgtcaaaatttaatgtttcataataaaaatagatacgttgactta

SEQ ID NO: 321092 - DNA, 2411 bp, Homo sapiens
cagaagtggattcagtgaatctaggaagacagcagcagacaggattccaggaaccagtgtttgatgaagctaggactgaggagcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgaaaaggcga

SEQ ID NO: 321093 - DNA, 3160 bp, Homo sapiens
  misc_feature (1)..(2): n is a, c, g, or t
  misc_feature (4)..(4): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccattccttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagtgaaaagagatgaactgaactgggaacacagataagtgataacgaaaaccggcgggctaacatcatctaaacgcagccacatcataacaacagagactaataattacttcggtattttattatttatatttg

SEQ ID NO: 321094 - DNA, 1712 bp, Homo sapiens
  misc_feature (1)..(2): n is a, c, g, or t
  misc_feature (4)..(4): n is a, c, g, or t
  misc_feature (1712)..(1712): n is a, c, g, or t
nncncgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcacaggtaatccgttcagctgcggtatatgtgggggtggtcccacggttcctccaactgggtgcgcttgccctgtcctgggtgagaatggccccagaacatggcccggtcctggccagttggacccctgtttttcacggcgctttccgggcacacacaggggtatacggttcgcggcaccgcggcgttaccagtctcgagaggacaagccagtcgggttttcccgtattctttcgtctcttttn

SEQ ID NO: 321095 - DNA, 3630 bp, Homo sapiens
  misc_feature (2120)..(2120): n is a, c, g, or t
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaantagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggaccagggataacctatgacttgggaaagagatgagttaggcagtcaagggtgacattcaatcagggatccacaagtggctggaaagaaatgctggtcctgtgtcctaactttttccacctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgcctaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccacactgcctacactagtgga

SEQ ID NO: 321096 - DNA, 622 bp, Homo sapiens
aaagctctggccactgccaccacctcctctcctaacactaccactggtcttcccctgccctgggccaggaccagagctgggctttgggttgggtggccttcgttgcatgcaccacggtgacagccacagcagccccagctctcagactggctgactgcacccagagagctctgacttccccagggcttccgggaaaggctgagtaacaaaacatggaaatgattgtctgtggggtaaatgttgaataatggaagatgggagacaggaaggagccagcagataaatggcttctccttcttccctaggatagaactattcagagaagctgtaactccccagggacaggtcttgtgattcagcaaccagctgtaccgctgatggagctacggtcagctcggcacacacatcgcctgaccacctgtgtttgctttctctcattccctgccttacagcccctgtcccccttatgcccatttccctgggattgaacccccaaataaagtgttaagatatgaatttaatgtagaaaacttaagttttctgagaaacctgggctaagactatcaaacagatgtagctctttgattataacgttattaagttctaaggcaatagcaaacaa

SEQ ID NO: 321097 - DNA, 3840 bp, Homo sapiens
  misc_feature (2330)..(2330): n is a, c, g, or t
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggaggtaagtcctgggtgcaggaccacagggcaggagatgcccttgtatgagggagcagcttccagaagtaatgggaaggaggaccacccttcagagaaacccatcctggaggaccaagcaccaaggcgccaggcagaaagcaaagtggtttggcaatccagggctgggggatagaaggcaaggatgggaatgtgagtgtttttaccctcccagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaantagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggaccagggataacctatgacttgggaaagagatgagttaggcagtcaagggtgacattcaatcagggatccacaagtggctggaaagaaatgctggtcctgtgtcctaactttttccacctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgcctaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccacactgcctacactagtgga

SEQ ID NO: 321098 - DNA, 3516 bp, Homo sapiens
  misc_feature (2006)..(2006): n is a, c, g, or t
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgtcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaantagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggaccagggataacctatgacttgggaaagagatgagttaggcagtcaagggtgacattcaatcagggatccacaagtggctggaaagaaatgctggtcctgtgtcctaactttttccacctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgcctaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccacactgcctacactagtgga

SEQ ID NO: 321099 - DNA, 1876 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggatagaactattcagagaagctgtaactccccagggacaggtcttgtgattcagcaaccagctgtaccgctgatggagctacggtcagctcggcacacacatcgcctgaccacctgtgtttgctttctctcattccctgccttacagcccctgtcccccttatgcccatttccctgggattgaacccccaaataaagtgttaagatatgaatttaatgtagaaaacttaagttttctgagaaacctgggctaagactatcaaacagatgtagctctttgattataacgttattaagttctaaggcaatagcaaacaa

SEQ ID NO: 321100 - DNA, 1966 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccaggtggggcctccaagaatcatggggagttctaagaatagggtttaggtcctagagagatgagaaaacccagaggctgcatgccctacaggaagccttgcatatcatgggcactcaatgtgtgatgatgggaggaagagagggagggaaggaaaggatagtcagataaaagtgtaccaatagatgagtgggtggatggatggatgcagacaagcagagagatttcaaatgtctctttcacattcgaagatgatgttactggcctggctggtcttgaactcctgacctcaagtgattcacccgcctcagcctcccaaggtgctgggattacaggtgtgagccaccgctcctggccaacaaccaggcttttttaagacatcactcagagcctttaatttgctaatgtgagttgtgaatctctgagagaaggctaacggcatgcttgcaacttacttgtccacagacaagcctttctgccccagaagagaagaccattctagggtgctaatgagcaaagagggtgagggtggaatatcggagagcagcagggagtgcagggg

SEQ ID NO: 321101 - DNA, 2111 bp, Homo sapiens
  misc_feature (601)..(601): n is a, c, g, or t
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaantagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggaccagggataacctatgacttgggaaagagatgagttaggcagtcaagggtgacattcaatcagggatccacaagtggctggaaagaaatgctggtcctgtgtcctaactttttccacctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgcctaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccacactgcctacactagtgga

SEQ ID NO: 321102 - DNA, 487 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcagtaagtgacagcccgtacccgactttcaccctctaagtaaatgacagggcccaacccccacccccgcactcac

SEQ ID NO: 321103 - DNA, 305 bp, Homo sapiens
accatcttgttctaaccccctgccccagctcacaactctctctccctcttgatgtgagcagcacaaacccactttcagagctgtggagattggcccagaccaggatctggatgttgttgaaatcacagaaaacagccaggagcttcgcatgcggaactcaagtgggtaagtgaggggacaccttctggcctacagaaggcccccacatggacgctgctcttcaggttgcaaccagctcacctggaaccccaagcagccaggggaatgtaagcagacatcaggaagaactcctagccagatggatc

SEQ ID NO: 321104 - DNA, 2113 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctgg

SEQ ID NO: 321105 - DNA, 1970 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctgg

SEQ ID NO: 321106 - DNA, 1023 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggcctgtctctcaggtcctggtctccctgcactgtctttgctgttgggagagctgaatacccacgtgtgtggttgtgagaggcccttgggggttcttggcctgcggcggtccgtcggcaccgccgtctggggggtctgaccccatggctcagggcctgcgtggactcgtctttcccgggggggcggccccgggctcccgcggcgcttcgtccctccgcatccctg

SEQ ID NO: 321107 - DNA, 3477 bp, Homo sapiens
  misc_feature (1967)..(1967): n is a, c, g, or t
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagctggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctgtaagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcaaaaantagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggaccagggataacctatgacttgggaaagagatgagttaggcagtcaagggtgacattcaatcagggatccacaagtggctggaaagaaatgctggtcctgtgtcctaactttttccacctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgcctaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccacactgcctacactagtgga

SEQ ID NO: 321108 - DNA, 2176 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtggggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggaggtaagtcctgggtgcaggaccacagggcaggagatgcccttgtatgagggagcagcttccagaagtaatgggaaggaggaccacccttcagagaaacccatcctggaggaccaagcaccaaggcgccaggcagaaagcaaagtggtttggcaatccagggctgggggatagaaggcaaggatgggaatgtgagtgtttttaccctcccagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccaggtggggcctccaagaatcatggggagttctaagaatagggtttaggtcctagagagatgagaaaacccagaggctgcatgccctacaggaagccttgcatatcatgggcactcaatgtgtgatgatgggaggaagagagggagggaaggaaaggatagtcagataaaagtgtaccaatagatgagtgggtggatggatggatgcagacaagcagagagatttcaaatgtctctttcacattcgaagatgatgttactggcctggctggtcttgaactcctgacctcaagtgattcacccgcctcagcctcccaaggtgctgggattacaggtgtgagccaccgctcctggccaacaaccaggcttttttaagacatcactcagagcctttaatttgctaatgtgagttgtgaatctctgagagaaggctaacggcatgcttgcaacttacttgtccacagacaagcctttctgccccagaagagaagaccattctagggtgctaatgagcaaagagggtgagggtggaatatcggagagcagcagggagtgcagggg

SEQ ID NO: 321109 - DNA, 998 bp, Homo sapiens
gttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaaccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctgg

SEQ ID NO: 321110 - DNA, 490 bp, Homo sapiens
atgcaccccagcttctgctagcagctggctggggacacagggttcctcaggagcctgtcttgattggaaggcagcaagcagcctctcctagcacaggcaaactcgctttctcatttttgttcggctgtcattcatttccttcctgtgactgttttattgttttccattctctcaaggagcgcctttttgattgcctgtaaattcctctataatcatactcttccccacaaacatgagatcataactggataatttcttttcttgtgctgggtagtgcagtttgaatgtgaaggtcaaaagttgaaacttcaaaagagcaggcatcttacttccataatttaggctgtggttctgctttactgttttgcagatgattaaattgatctgaaggcaaggtgggaaataaaaggagatgctttcataccacctgatagctcagtgccttgggtttcggttaagtacctctggaagcgtcaggggagagcaggcg

SEQ ID NO: 321111 - DNA, 3094 bp, Homo sapiens
ggagcccagggctcgaggtgcgcggagcctgagtctgggctttccgaggacggcgagcagctgtgcccagagctctgggaaagtcccctctctttgcttcttataaattaagttcctttccaccagttagggcaagtccgccaagatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccagggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaaagacaat

SEQ ID NO: 321112 - DNA, 2975 bp, Homo sapiens
ggagcccagggctcgaggtgcgcggagcctgagtctgggctttccgaggacggcgagcagctgtgcccagagctctgggaaagtcccctctctttgcttcttataaattaagttcctttccaccagttagggcaagtccgccaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccagggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaaagacaat

SEQ ID NO: 321113 - DNA, 463 bp, Homo sapiens
  misc_feature (6)..(6): n is a, c, g, or t
gcggcngcctactactactactaaattcgcggccgcgtcgagttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321114 - DNA, 577 bp, Homo sapiens
tttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321115 - DNA, 927 bp, Homo sapiens
  misc_feature (927)..(927): n is a, c, g, or t
taaacttacggctaggtacgaggctgggtgagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaatttgggaaagctcatggagcttcatggtgaggcggagtctggaaagcctggggccggacgggctagtgacgagcgtgggttgacccgtccgattgttagtcgactcctgggcaaaggcttgggaaaaacaaaaaaaaatggggcggcccattaaacgtggggccgaaagaattcaaaggggggtgccacggcgggaatgttgtaacacgcgcgcggtan

SEQ ID NO: 321116 - DNA, 957 bp, Homo sapiens
atattgtcataccatagtaggaagaaaaacctttatttggaatatacaaacttacagtagtgagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaacaaaaaaaaaaaccggaggacatattggggggggaaaaagtagtga

SEQ ID NO: 321117 - DNA, 606 bp, Homo sapiens
tttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaagtcgacgcggccgcgaattta

SEQ ID NO: 321118 - DNA, 355 bp, Homo sapiens
  misc_feature (6)..(6): n is a, c, g, or t
gcggcngcctactactactactaaattcgcggccgcgtcgagattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaggaaaaaaccccccaggaggaggtagaaccgagcc

SEQ ID NO: 321119 - DNA, 239 bp, Homo sapiens
ggccgcctactactactactgctcgaattcaagcttctaacgatgtacggggacatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaataaaaagaaaacaaataaaaaactaaaaccaaaaa

SEQ ID NO: 321120 - DNA, 875 bp, Homo sapiens
taaacttacggctaggtacgaggctgggtgagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321121 - DNA, 799 bp, Homo sapiens
  misc_feature (38)..(38): n is a, c, g, or t
  misc_feature (42)..(42): n is a, c, g, or t
gaggcggggttaatcggacgagggcttagaaaggcggnaaanggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaaaatacacccgcacgtcgggcgaggaatttc

SEQ ID NO: 321122 - DNA, 930 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321123 - DNA, 1075 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaccaccaaaaaacacaaaaaactccaagagccacaatccgagcggggcacaaaaggcgctcaagagaacgggccacatggccataagaggatacactgcaccacgcttcattctggcaacagggggacaactgacacggcccaca

SEQ ID NO: 321124 - DNA, 1083 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacggaacaaacacactaaaaaaaaaaaaatttggtgggcggctcggccctaaaaaagttttataacctttgtttgggggcggccaagggtattacaccgtgccactgtccccggaacccggctcaactgtgggggttccccaaaaacccgggag

SEQ ID NO: 321125 - DNA, 1014 bp, Homo sapiens
  misc_feature (942)..(942): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacacaacaaaaancaagaacacaagaagccaggggcaaaacgggcgcgacacagggacataaagcgcgggccaacgggtcgcgac

SEQ ID NO: 321126 - DNA, 1037 bp, Homo sapiens
  misc_feature (948)..(948): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacaacaaaaaacaaaacanaaacccgggctcttgggggggaaacaggtaaaaggcactgttatgttccggaccctttttaagggaaagcggccaaagggaatacaacg

SEQ ID NO: 321127 - DNA, 1029 bp, Homo sapiens
  misc_feature (947)..(947): n is a, c, g, or t
  misc_feature (996)..(996): n is a, c, g, or t
  misc_feature (1000)..(1000): n is a, c, g, or t
  misc_feature (1002)..(1002): n is a, c, g, or t
  misc_feature (1004)..(1004): n is a, c, g, or t
  misc_feature (1008)..(1008): n is a, c, g, or t
  misc_feature (1015)..(1016): n is a, c, g, or t
  misc_feature (1019)..(1019): n is a, c, g, or t
  misc_feature (1024)..(1024): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacacaacaaaaaaaaaanaaaaaaaaaaaatttggggggggctggggcctgggaaaaagtttttaancccncncngtgnggggcgnnggncccangtagg

SEQ ID NO: 321128 - DNA, 992 bp, Homo sapiens
  misc_feature (946)..(946): n is a, c, g, or t
  misc_feature (950)..(950): n is a, c, g, or t
  misc_feature (954)..(954): n is a, c, g, or t
  misc_feature (965)..(965): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaagaaaaaggaanttcncgcngccgcgatttnggtgtagtgtcccccgcggattccgcc

SEQ ID NO: 321129 - DNA, 1364 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaaaaaaaaaaaaaaaaaaaaaaaaaaaaaaaaaaaaaaaaaaaaaaaaaaaaaaaaaaaaaaaaaaacaaaacaaaaacaacaaaaaaaaaaaaaaaaaaaaaaaaaaaaaaaaacaaagggacaaaaaagcgaacgggccggcgggcgagccgcagacgaacacgcggaggggcgcaggaaaaagactgcaacacacagaacgccagatacgaaacgcatgacagacagaacgcacgaagcagccaggcagacgacacgcggaagcaggagcagcagaagaaagaaacgaaaccacagagtgggcgagcaagaacagggggaaggaacccgcagcaggaaccagccaggctcgggaggggagcgcggaacgacgacggtcaaaagggcgtaacaggaagaggacatcacatagcagagaggggagaa

SEQ ID NO: 321130 - DNA, 1070 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaacacacaccaaaaaatccaaggctcttattcgggtcgccaaaagagttactcaatggccatggcaaagcgtttccgaaccacttttctttccaggggaaattgcggttcccctaaggagcgattaatcgaaacccgatcc

SEQ ID NO: 321131 - DNA, 881 bp, Homo sapiens
aacggctagtacgaggccgggtgttaatcggccgagagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321132 - DNA, 1467 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaacaaaaaacaaaacaaaacaacccccggggctttttattccggggggcggaaaaaacaggtctgcgcacggggcccactggggccacaaagggtgttcccggacccagtttttctttgcgtccccacgagggggggtaagaattctgggcccggggatctcccccatatagaggggacggtcggcaaatatacaaatttctcgcaataaagcgcccgcgggttttaaccccgggacgttaaaaggaaacgccgcggcacaaagagcccgcaaaccgccgacgcgacacaccacagcaggccacgccgccaccaccaacacacgggggctacaacccaaccaactagagacacacaacaacacacacgcgcgaccacggccaaaaccaccaccacagccacacctgccgaaaccacagacccccaacaccgacgaccaccaaagaacaatcaacaccgagaccacacacgccgacccgccccatactcaacaaccaccgaccatccgacagcacaccaacgaccgaccagcaacgaa

SEQ ID NO: 321133 - DNA, 1176 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaacaaaaaaaaaaaaaaaaaaaaaaagaagaaaaaaaaaaaaaaaaaaaaaaaaaaaaaaaaagcgggggggatatttgggggggggagcagaaaaagaggaagaaaaaagagcggcagaagagagagaacaagaggatagacacacacgcaagatcctgtagaaagagggggaaaaattagcgggagcccccaaaagggagggacaaaaaacagagaaagcgcaggagacaccgaaaaaagaag

SEQ ID NO: 321134 - DNA, 971 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacactttttatttgccactatttggtcgacgcggccgcgaat

SEQ ID NO: 321135 - DNA, 957 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatataaccccccgagggttggcctactc

SEQ ID NO: 321136 - DNA, 1136 bp, Homo sapiens
  misc_feature (1136)..(1136): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaaaaaaaaaaaaaaaaaaaaaaaaaaacccgggggccacatatggcggggggcgcgagaaacagcggggtatcgagaatggggccactgggtccaaaacgtgtctctgggaccaagttttctgtgtaccaaggggggaacctcggggggccccctaaaggggagcgcgaaaaattcagaaaacccggttaaccggtaagn

SEQ ID NO: 321137 - DNA, 969 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaggctccgcgtgggcgcggggtggttcgtgggtctgtcgt

SEQ ID NO: 321138 - DNA, 1082 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcgggttggtgcacccaggaacgcggcctggaggggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321139 - DNA, 1016 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatgggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321140 - DNA, 897 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggagcggcacatgggttgggggatcctaaagagtcgtgctgcatgcgtagggtaactgacgtgagcagacaagatccc

SEQ ID NO: 321141 - DNA, 982 bp, Homo sapiens
  misc_feature (982)..(982): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaatttgggaaagctcatggagcttcatggtgaggcggagtctggaaagcctggggccggacgggctagtgacgagcgtgggttgacccgtccgattgttagtcgactcctgggcaaaggcttgggaaaaacaaaaaaaaatggggcggcccattaaacgtggggccgaaagaattcaaaggggggtgccacggcgggaatgttgtaacacgcgcgcggtan

SEQ ID NO: 321142 - DNA, 638 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321143 - DNA, 742 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321144 - DNA, 727 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaacaacaaacacaacaaccaaaacaacccccggagaccacccccacaccacctgcggcgccccaagggcgccacccgggccccccacg

SEQ ID NO: 321145 - DNA, 840 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaatttgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatttgtgatggtttgcttctg

SEQ ID NO: 321146 - DNA, 1396 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaatttgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaaaaaaaaaaaaaaaaaaaaaaaaaaagagggggcggccgcgcccctaagagattttcccctcgcggggggccccagattcttcgcgcgcgtccccgagtttttttggggtaccaagggggcccccttaaaggagagagctccgtttattaataagcctagaggccacggtggaccccaccgtttttacacacagacggttcgggtgaagcggggaaacaaccctgctctaacccgtgggagaaatcctgtggcgcgaagaggaaccctcttatcttctcgggggggggtgggcaacctttatgtgcggcacacaacacctctaccctctgaacggagagatatttaaaggcgctctctatagggcggataaaatttatataaacacttgtttcaaaagcgcttgttatacacgcggcgtgtctaacaccattaagccggtcgccaaatatatgccctgggcccgtgccctgtgaaagaaactttttgtgggctatagcccgggaatttatttgactttttctgtgcaagacctctttttattcccccgggagcttcgtgtgcaaatacc

SEQ ID NO: 321147 - DNA, 693 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaatttattccagtaacagcttactttcgggtaccgagcttgaa

SEQ ID NO: 321148 - DNA, 948 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggcacgagcgataggaacatacatgatcgccgagcgacgggcacgacgacgatgagatccttgaacactgaaagcggtcaatacaagccgatggaccaagaacatgcatagcggccaagacacagaaacaacgagtttgccaatctaagtatgcctttccatatgtctttgttagaaaagatatctatgcatgatcgatgaccaaagttgatgatgctccgaccatacgctcttgcgagatttattggtgagacgtcagtcagtgtatgcacacagacgctatcgtcgctacgagataggtggagaagaggaacgagcgtgagaacctataaccacgtgctccaattgatt

SEQ ID NO: 321149 - DNA, 634 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggggggtgtggattagccgggggggcagcaatgcttg

SEQ ID NO: 321150 - DNA, 632 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaatttgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321151 - DNA, 315 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaccaaattgctctgtgtctcaggcggagggctagccagagagctgaacagcacagacag

SEQ ID NO: 321152 - DNA, 418 bp, Homo sapiens
aaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcaggtgagacccaaagttccttagagtggttgtgctatgggtgtttgaccaaggatagcatggtttgatgactggaaggagcaagttcattttatttatttattgagaccagtgaaatgtccacaaagttcattttaaatttttgttttcttgccgttgttgagtgctaactctggggttgccacaccatattttacttactatttaaatctaagatttaatagtggtgtatc

SEQ ID NO: 321153 - DNA, 988 bp, Homo sapiens
  misc_feature (899)..(899): n is a, c, g, or t
aacggctagtacgaggccgggtgttaatcggccgagagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacaacaaaaaacaaaacanaaacccgggctcttgggggggaaacaggtaaaaggcactgttatgttccggaccctttttaagggaaagcggccaaagggaatacaacg

SEQ ID NO: 321154 - DNA, 907 bp, Homo sapiens
atattgtcataccatagtaggaagaaaaacctttatttggaatatacaaacttacagtagtgagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321155 - DNA, 973 bp, Homo sapiens
  misc_feature (891)..(891): n is a, c, g, or t
  misc_feature (940)..(940): n is a, c, g, or t
  misc_feature (944)..(944): n is a, c, g, or t
  misc_feature (946)..(946): n is a, c, g, or t
  misc_feature (948)..(948): n is a, c, g, or t
  misc_feature (952)..(952): n is a, c, g, or t
  misc_feature (959)..(960): n is a, c, g, or t
  misc_feature (963)..(963): n is a, c, g, or t
  misc_feature (968)..(968): n is a, c, g, or t
ttatttcagtgctgggctggcgcttacttgtacgttacgtgtgccatcgatcctgccatattctacacggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacacaacaaaaaaaaaanaaaaaaaaaaaatttggggggggctggggcctgggaaaaagtttttaancccncncngtgnggggcgnnggncccangtagg

SEQ ID NO: 321156 - DNA, 557 bp, Homo sapiens
  misc_feature (6)..(6): n is a, c, g, or t
  misc_feature (48)..(48): n is a, c, g, or t
gcggcngcctactactactactaaattcgcggccgcgtcgacaaaatntgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321157 - DNA, 874 bp, Homo sapiens
ttatttcagtgctgggctggcgcttacttgtacgttacgtgtgccatcgatcctgccatattctacacggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321158 - DNA, 980 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaacaaaaaaaaaaaccggaggacatattggggggggaaaaagtagtga

SEQ ID NO: 321159 - DNA, 1244 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaacaaaacaaaaacaacaaaaaaaaaaaaaaaaaaaaaaaaaaaaaggggggggggggaaaaatttcccggggggggcccatttggggaaccccaggttttttggtacaagggggggccaaatgggggggggatataaaagaggggccggggggggggtttaaaacaggtggtggcgggaaaatgtctctgtgggaatttgtgggaggacctatttgggggggaatattgtggaagactctagaaaattaagtcagggaaatatactagggttagggtgacaggattcgtggggaatgtcgagatattgaata

SEQ ID NO: 321160 - DNA, 998 bp, Homo sapiens
  misc_feature (954)..(954): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacttcgtggaacacaacacaaaccnggggctttttggggggaaacgggcagggcgggcactgttccgcc

SEQ ID NO: 321161 - DNA, 1207 bp, Homo sapiens
  misc_feature (952)..(952): n is a, c, g, or t
  misc_feature (956)..(956): n is a, c, g, or t
  misc_feature (1197)..(1198): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgacacgactcataggggataaaangccntgggcggttcacaaaaaaaaaccgggtctattcgggggggaaaagttgaaaggacagggtaaatgtgtttggacccttttgttgaaggggaataggggcccaaagagggtaataggagatgagtatttcatcatacatacactaaaaacacagaagaagataagaatacataaaacaaagaaaagacgagagaataaggcaagagagcataagaaagcaacaaaagaagagaaatgagggnnggctactat

SEQ ID NO: 321162 - DNA, 983 bp, Homo sapiens
  misc_feature (942)..(942): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaacaacacacanacacaaaaacccggggcctataaatccaggagtccgcacac

SEQ ID NO: 321163 - DNA, 1512 bp, Homo sapiens
  misc_feature (1006)..(1006): n is a, c, g, or t
  misc_feature (1008)..(1008): n is a, c, g, or t
  misc_feature (1012)..(1012): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaaaaaaaaaaaaaaaaaaaaaaaaaaaaaaaaaaaaaaaaaaaaaaaaaaaaaaaaaaaaaaaagggggngncgcnccaaaaaatccccccggggggcgccccatccgccccccccccttttgttttcaaagggggccccccaaagggggggttataatacacatcgcaacgaggcggcggcccgcgtttaataacaacagccgtttggtggctgatgagaacataactgcgccctagtcctggtgcgatcaactcttgtggagaagagcaagcccccaattatctggtggggggggggagcgccaaaaaacatgtggtgggggcgcccaacaaccaaccccatcagaagaagtattatatacggcgcgcctctgtgaggagagaaacaatatcaacaactctcagacgcggggggtctatatcgggggtggggtaacaaccaacacggtacaatacatcatttcgcctgtggcggctgaaagaaaaacgtgttcgtgctgctcacacgagagagagttatctctatttcagagaaatttttttcacgcggggcggtgtggtgattaaaaactgac

SEQ ID NO: 321164 - DNA, 1455 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgagtgcaaaaaaaaaaatgaatggatagaaaagaacagaaaaaaaatatagataacgaaaaaaggaggagggggggctatagagataatagcgaggggagggaccaatatatggtgggagacacgtttgtttgagaacacagacgagggccaccaaaaaaataagaagccgctgcatcataaaacagagacagcaagcggcgcagcacagagtaaacacagccagtcgcgacacatggcgaacacagaggctagaacaggggacgggaccctttggggacaaaagaagaaacacaacaagtacgagcggagggggcacacaacaaataagcagagcccaccacaacccacccgaaagagaaataaagaacccacgtagaggggcgaaaaaaaacaaacacactaaagcgataagtaaacgggtggagctaagtaacacaaagcgccgcagaacgcgcgtgacaagcacaaagaaaagtacacggacagccaacgcaggaaatagaataagtgaggcagacagcgttg

SEQ ID NO: 321165 - DNA, 960 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaagttaacggtaggagagacattgggatcc

SEQ ID NO: 321166 - DNA, 988 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagttgaaaaatacagtaagaattgatctgcaatggaacttaagcatcttcttaaaatccagggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321167 - DNA, 993 bp, Homo sapiens
  misc_feature (313)..(313): n is a, c, g, or t
  misc_feature (315)..(315): n is a, c, g, or t
  misc_feature (327)..(327): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaagagttgggcattcttggaatgggttcgtcaaaaggggattcgggtggttagttntntggaaaaacggnttgggaaagggttttcctttggcttggaatttttgggccagaaaatgggatgcaaagttggcattgtagcagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321168 - DNA, 1628 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcgggttggtgcacccaggaacgcggcctggagggtcggtgttgagtagcggcagggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgagtgcaaaaaaaaaaatgaatggatagaaaagaacagaaaaaaaatatagataacgaaaaaaggaggagggggggctatagagataatagcgaggggagggaccaatatatggtgggagacacgtttgtttgagaacacagacgagggccaccaaaaaaataagaagccgctgcatcataaaacagagacagcaagcggcgcagcacagagtaaacacagccagtcgcgacacatggcgaacacagaggctagaacaggggacgggaccctttggggacaaaagaagaaacacaacaagtacgagcggagggggcacacaacaaataagcagagcccaccacaacccacccgaaagagaaataaagaacccacgtagaggggcgaaaaaaaacaaacacactaaagcgataagtaaacgggtggagctaagtaacacaaagcgccgcagaacgcgcgtgacaagcacaaagaaaagtacacggacagccaacgcaggaaatagaataagtgaggcagacagcgttg

SEQ ID NO: 321169 - DNA, 1027 bp, Homo sapiens
  misc_feature (518)..(518): n is a, c, g, or t
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttataaggaaaataatttccaaaaaggcttcgacttctgaaccttccgcacaccggaattcgctctccacgcgcgctcacacaaaaaccttaggacgcctttgggaaactttaaacacaccattataacacccacattaggacggacacaaattggggaaactacctataaccccgtgacaaaatntgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321170 - DNA, 875 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321171 - DNA, 1197 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgtaagtgtttctttgcttcctcacacaacacaaccttgagtattggattattcctgagatgagagaacgcatatgagacaaggtaaaggtctgttgaaatcctgtctgtgaatccttctagctatatctctttaagttgaaagagtgttaagtactcaagtaaatatgattattacttactattattatttgagtcagagtcttgctctgttgcccaggctcgagtgcagtattgtgatcctccttggctcactgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctaaatgataacagttttttcgtgtttatttattttgaatgaagctgtctcacagtagatggagttgaaggacaggaaatgtttttcccctacttggaaaatacactgaata

SEQ ID NO: 321172 - DNA, 820 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaatttgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321173 - DNA, 875 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatgggattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 321174 - DNA, 907 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaccatcggtagtcttgacatcaacgtgagcttcaatcattgtctgccattttttgaccatggaacacattttgtcacgggtaagatccatgccatggaagttagtcaggcagtttttaccctgaacatcttcagtaatcagcttgaattttctaaatgcaacttcatcattctgcaaatcagcaagactcacttcaaacacacgacccttgagaccatcagatgcaattttggttccttgggtcctggtgacgagcgtctttccaatatttggtatattgaacatagcaggtgctttcacgtcgacc

SEQ ID NO: 321175 - DNA, 454 bp, Homo sapiens
aacggctagtacgaggccgggtgttaatcggccgaggcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaccaaattggcatctaatggctctcaggggtcggtgtgtttaaagtgagtctcgctgattcacagagtgatgaggtgacatagagagatacacgctgatcactagagtgtacaggaaaactactgcctctatcactacgtcgcatggctctcaccgacacatatgtgctacgatgacaaatgtgccgactatgatgcg

SEQ ID NO: 321176 - DNA, 350 bp, Homo sapiens
gtattattgctcatttacataaaagattagattcagttcatatgaactagtttatactggtaaaatgtttctttaaaaacaacaacctgagttaatttgtatttaagaaataatcctaattgaaaaattcttaatgattaggggcagcaaagaaaactgtataatcaagtcagcaggacagattctacttacatttgtcttttatttattctgtataagaataagcatttcttattccaactgcagcatgactgtcactaaaaagattttgatgttcaaagacaagtcattgagagttcttcggttttcttccttcaaaaacattgaatgattttatgctacataccagg

SEQ ID NO: 321177 - DNA, 342 bp, Homo sapiens
tcaatctcaataaaaagttattttctaaacaacgaatgaatgaaataagcaattaatagtataatcatctagatattgagagataaagaacaaaaacaatattttattaagcttgtggagtgtggttaacaatgagcccaaaggttaattgatgatgttgaatgcttttactgtttaaaaagaaagactaggccaggtgcggtggctcacgcctgtaatccgagcactttgggaggccgaggcggggaggaccacgagttcaagagattcctggccaacatggtgaaatcccatctctactaaaaatacaaaaattagctgggtgtggtggtgcaggcctgt

SEQ ID NO: 321178 - DNA, 480 bp, Homo sapiens
  misc_feature (6)..(6): n is a, c, g, or t
  misc_feature (21)..(21): n is a, c, g, or t
ccgccnctcgacgcggccgcntcgactacggctgcgagaagacgacagaagggcaggtgaccactcaagttctttcaatgaagacctgatgatgtatttagttcccattttccacggtgattgactcaatttaagtgtattgtggctatatgtaatttacaggctgctttgcgttgcaggtgggaaaatctcccaggctggtgtgaggctgaactggggtaaaagaccccctgacccctcctcattcttctaaggtcaccacctcttagagggtctcttattttctttcagagatcaaatgcacagttatgctgtacaactaaattctgcagtcttgggaatccttacgagtaccaactattagtcactttttaaagtccccaaagtggagtgaggatagggggagtggaagcagtgtttggttcttactttacccaaactgtgtataaagaataaagttagcagaatgatgccacagtc

SEQ ID NO: 321179 - DNA, 3509 bp, Homo sapiens
aggaggaagaagaggaggaggaggagggggccggtgtcccagcttgcccgcccaagggcccaggcgacgttccgctgtcccctggagctcccttggagcggcccgccgaagaagaggaggacgaagaggacggccaggagcctgggggactcgccttgccgccgccgcctcctcccccgcctccgcccccgccccgcagccgggagcagcggcggaactaccagccgcggtggcggggcgagtacctgatggactacgacggcagccggcgcggcctggtgtgtatggtgtgcgggggcgcgctggccacgctcaaggtgagcaccatcaagcgccacatcctgcaggtgcaccccttctccatggacttcacgcctgaggagcgccagactatcctggaggcctacgaggaggcggcgctgcgctgctacggccacgagggcttcgggccgcccgccccggcgccgcgtgacggcggcgcggacctcaagtctggcgctgtgtgtcgggcgtagcggcctagcgggcccccgggtcaggtcgggtcgggtcggatcggccccgccccgccctgtgctcgcccggcccttcggctgggagaccctcgcgtccggtgttagcgcttcccgcggccgcgccccccgctggccgggccgggcggagacgggggatcgggtggggccaccggcgtctgcgcggtgccacttgggtccctgagccagtcggtgcgctgcgggaagcgcactctcccatcggcccggagccctgccctccccgcgcagggcccacgttttccgagaatcctcagtggcctccacgtgttagcgccgagcgctcccggccgcaccccgcgagggggttctccgcaggccgggactgggggcgccgtcagtcagtattagggccgaaggggggccgtgcgggctctggctctggccctggctgggggcccagttccctgcagccttgcacgctggcaggcacggctcccggcttgggggctgctggctgcccttccctaattgggattctcggcctctcggaggccccggctgcggactggggcttccagcgggaggctgggccgcagggctcgggagccttcccggggtgggaaggcgcgttggaccgagggcggggctacgcgcccggggcccgggctggaccagctgcgcttacctccccggcaggctcagtgagaaccgtgcgcccggcggccccactctcctcccaggccgctgccacgccctccaggaaagctcttgtaaagggattagcacttttttcctttgctcctcttgccccgagggtctctgctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcctaaggttcaagtgcctcaggcccagtccccttgacgcttcctgtttgggagttggattttataccacggattttatagcatttttatataattgaggattgtcagaattggaaagggccctggagatcactagtactaccctcctcaccttcacagataggtaaattggagcccaggaaccgagatgatcacacagccaggtagggacagtacaagaactagaatgaaaatcctagctcctgactcagtgttctttgcacgatgccacactgcttcccaattcgctggtcagttattaaaatttgtcaggcctgccgaaggattgacatgctgggcaatgcaggccaccacggtggatctgtgactcctgaaggtggcaaagccctgcacactgccttgggatgagcacactgagctctgcagggcctcagctggaaggcgccatccaatcgtccttcccctccccagcagaactccagaggtggggcggctgccgcagggcccaaggctgcctcggcagggggctttgtgctttttgttgtggaggccaccagggattcaggaagatcctgaatgggttgtcaattgactgaaaagtaaattcccagtgagtttgaacctccacggtttttgagacagtattaaaagcttgagaacggagattatggatggcaccaggctgggcactgccattcttttactttccttcatgcattttttcggatccagagtattaacaccactttttttactctgcccattcaaaaacagtaggcaaattgggggaaccaatttataatcactcaagcccactgccaaagttcggataagccagggcagaggggttagattcccccccctccgtaggcagagagaggcctcaggagagtggacatctttactgagacagccccaaacacaccagtggctctcaaagtgtgtccctgagaccagcagcatcaccttaggaatctgctagaaataaaaattcttgggccataccccagggttactgaatcagaaacttggttggggcctagcagtgttttcatgagccctccattgatcttgatgcagctgaagtgccgggcaccagtgaaagggaagggctgcggtagtgattccattgattcctgctttgatggaagttatggcctcacaggttagacgttgcaagttgagttggccctcttgcctaggtgtgcctccttgccttgggattctgacatgaacaggtgaagtctcttcatgattttttttgttgttgttgttaatggtatgcttgctattatggccaatatgtaaatgttactctgaatacatatttatataccatgttacttagtgacattattcaaacatttgtatgcgtatttgtgaaattgtttgcatcagtcatttaaaaaatatttcagcctaagttttctaagaggtatgttgaatacatttttaaaagccagcttaagggtcacagcagccttagtttaggagaagagctaatcacaggtgaccactcaagttctttcaatgaagacctgatgatgtatttagttcccattttccacggtgattgactcaatttaagtgtattgtggctatatgtaatttacaggctgctttgcgttgcaggtgggaaaatctcccaggctggtgtgaggctgaactggggtaaaagaccccctgacccctcctcattcttctaaggtcaccacctcttagagggtctcttattttctttcagagatcaaatgcacagttatgctgtacaactaaattctgcagtcttgggaatccttacgagtaccaactattagtcactttttaaagtccccaaagtggagtgaggatagggggagtggaagcagtgtttggttcttactttacccaaactgtgtataaagaataaagttagcagaatgatgccacagtc

SEQ ID NO: 321180 - DNA, 2192 bp, Homo sapiens
aggaggaagaagaggaggaggaggagggggccggtgtcccagcttgcccgcccaagggcccaggcgacgttccgctgtcccctggagctcccttggagcggcccgccgaagaagaggaggacgaagaggacggccaggagcctgggggactcgccttgccgccgccgcctcctcccccgcctccgcccccgccccgcagccgggagcagcggcggaactaccagccgcggtggcggggcgagtacctgatggactacgacggcagccggcgcggcctggtgtgtatggtgtgcgggggcgcgctggccacgctcaaggtgagcaccatcaagcgccacatcctgcaggtgcaccccttctccatggacttcacgcctgaggagcgccagactatcctggaggcctacgaggaggcggcgctgcgctgctacggccacgagggcttcgggccgcccgccccggcgccgcgtgacggcggcgcggacctcaagtctggcgctgtgtgtcgggcgtagcggcctagcgggcccccgggtcaggtcgggtcgggtcggatcggccccgccccgccctgtgctcgcccggcccttcggctgggagaccctcgcgtccggtgttagcgcttcccgcggccgcgccccccgctggccgggccgggcggagacgggggatcgggtggggccaccggcgtctgcgcggtgccacttgggtccctgagccagtcggtgcgctgcgggaagcgcactctcccatcggcccggagccctgccctccccgcgcagggcccacgttttccgagaatcctcagtggcctccacgtgttagcgccgagcgctcccggccgcaccccgcgagggggttctccgcaggccgggactgggggcgccgtcagtcagtattagggccgaaggggggccgtgcgggctctggctctggccctggctgggggcccagttccctgcagccttgcacgctggcaggcacggctcccggcttgggggctgctggctgcccttccctaattgggattctcggcctctcggaggccccggctgcggactggggcttccagcgggaggctgggccgcagggctcgggagccttcccggggtgggaaggcgcgttggaccgagggcggggctacgcgcccggggcccgggctggaccagctgcgcttacctccccggcaggctcagtgagaaccgtgcgcccggcggccccactctcctcccaggccgctgccacgccctccaggaaagctcttgtaaagggattagcacttttttcctttgctcctcttgccccgagggtctctgctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcctaaggttcaagtgcctcaggcccagtccccttgacgcttcctgtttgggagttggattttataccacggattttatagcatttttatataattgaggattgtcagaattggaaagggccctggagatcactagtactaccctcctcaccttcacagataggtaaattggagcccaggaaccgagatgatcacacagccaggtagggacagtacaagaactagaatgaaaatcctagctcctgactcagtgttctttgcacgatgccacactgcttcccaattcgctggtcagttattaaaatttgtcaggcctgccgaaggattgacatgctgggcaatgcaggccaccacggtggatctgtgactcctgaaggtggcaaagccctgcacactgccttgggatgagcacactgagctctgcagggcctcagctggaaggcgccatccaatcgtccttcccctccccagcagaaatccttacgagtaccaactattagtcactttttaaagtccccaaagtggagtgaggatagggggagtggaagcagtgtttggttcttactttacccaaactgtgtataaagaataaagttagcagaatgatgccacagtc

SEQ ID NO: 321181 - DNA, 427 bp, Homo sapiens
gtgcaaatgtcttatttattatgcgtgtatcagagataagctgtgaggtggtggagggaggacctgaaggaaggaggagcgagggcagaggcggggacgggaggaccccaactagctgtgctgatgttaatcccgctgggagactccgggccctactgtctgcctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcct

SEQ ID NO: 321182 - DNA, 3116 bp, Homo sapiens
aggaggaagaagaggaggaggaggagggggccggtgtcccagcttgcccgcccaagggcccaggcgacgttccgctgtcccctggagctcccttggagcggcccgccgaagaagaggaggacgaagaggacggccaggagcctgggggactcgccttgccgccgccgcctcctcccccgcctccgcccccgccccgcagccgggagcagcggcggaactaccagccgcggtggcggggcgagtacctgatggactacgacggcagccggcgcggcctggtgtgtatggtgtgcgggggcgcgctggccacgctcaaggtgagcaccatcaagcgccacatcctgcaggtgcaccccttctccatggacttcacgcctgaggagcgccagactatcctggaggcctacgaggaggcggcgctgcgctgctacggccacgagggcttcgggccgcccgccccggcgccgcgtgacggcggcgcggacctcaagtctggcgctgtgtgtcgggcgtagcggcctagcgggcccccgggtcaggtcgggtcgggtcggatcggccccgccccgccctgtgctcgcccggcccttcggctgggagaccctcgcgtccggtgttagcgcttcccgcggccgcgccccccgctggccgggccgggcggagacgggggatcgggtggggccaccggcgtctgcgcggtgccacttgggtccctgagccagtcggtgcgctgcgggaagcgcactctcccatcggcccggagccctgccctccccgcgcagggcccacgttttccgagaatcctcagtggcctccacgtgttagcgccgagcgctcccggccgcaccccgcgagggggttctccgcaggccgggactgggggcgccgtcagtcagtattagggccgaaggggggccgtgcgggctctggctctggccctggctgggggcccagttccctgcagccttgcacgctggcaggcacggctcccggcttgggggctgctggctgcccttccctaattgggattctcggcctctcggaggccccggctgcggactggggcttccagcgggaggctgggccgcagggctcgggagccttcccggggtgggaaggcgcgttggaccgagggcggggctacgcgcccggggcccgggctggaccagctgcgcttacctccccggcaggctcagtgagaaccgtgcgcccggcggccccactctcctcccaggccgctgccacgccctccaggaaagctcttgtaaagggattagcacttttttcctttgctcctcttgccccgagggtctctgctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcctaaggttcaagtgcctcaggcccagtccccttgacgcttcctgtttgggagttggattttataccacggattttatagcatttttatataattgaggattgtcagaattggaaagggccctggagatcactagtactaccctcctcaccttcacagataggtaaattggagcccaggaaccgagatgatcacacagccaggtagggacagtacaagaactagaatgaaaatcctagctcctgactcagtgttctttgcacgatgccacactgcttcccaattcgctggtcagttattaaaatttgtcaggcctgccgaaggattgacatgctgggcaatgcaggccaccacggtggatctgtgactcctgaaggtggcaaagccctgcacactgccttgggatgagcacactgagctctgcagggcctcagctggaaggcgccatccaatcgtccttcccctccccagcagaactccagaggtggggcggctgccgcagggcccaaggctgcctcggcagggggctttgtgctttttgttgtggaggccaccagggattcaggaagatcctgaatgggttgtcaattgactgaaaagtaaattcccagtgagtttgaacctccacggtttttgagacagtattaaaagcttgagaacggagattatggatggcaccaggctgggcactgccattcttttactttccttcatgcattttttcggatccagagtattaacaccactttttttactctgcccattcaaaaacagtagacgttgcaagttgagttggccctcttgcctaggtgtgcctccttgccttgggattctgacatgaacaggtgaagtctcttcatgattttttttgttgttgttgttaatggtatgcttgctattatggccaatatgtaaatgttactctgaatacatatttatataccatgttacttagtgacattattcaaacatttgtatgcgtatttgtgaaattgtttgcatcagtcatttaaaaaatatttcagcctaagttttctaagaggtatgttgaatacatttttaaaagccagcttaagggtcacagcagccttagtttaggagaagagctaatcacaggtgaccactcaagttctttcaatgaagacctgatgatgtatttagttcccattttccacggtgattgactcaatttaagtgtattgtggctatatgtaatttacaggctgctttgcgttgcaggtgggaaaatctcccaggctggtgtgaggctgaactggggtaaaagaccccctgacccctcctcattcttctaaggtcaccacctcttagagggtctcttattttctttcagagatcaaatgcacagttatgctgtacaactaaattctgcagtcttgggaatccttacgagtaccaactattagtcactttttaaagtccccaaagtggagtgaggatagggggagtggaagcagtgtttggttcttactttacccaaactgtgtataaagaataaagttagcagaatgatgccacagtc

SEQ ID NO: 321183 - DNA, 1018 bp, Homo sapiens
cagaaaaagtgctccctttcctgtcctgtggtgccaccatcctgtcctccttcgtaatcatgaacaatctgatcttgaactcccacataacttaaatcaggcaaaaagaaacattcacagcgtccccttgctgaataaaaatgactttgtttggaggcacttaagatgtatgcctgtgtgtggtgccgcagcattgaaattatctgtagaaggggaattttttttaaaaatacaattttatcactagaaataaattccgatggtggaaacgaagaaaacccttaaattatatcacaaaagccattattttttgcatccaaagagtttttttttttaaggaaaatcattctactttgagaactgtaattaaagccctaaataacagacactactttgttgagctattgtgaaaaaaaaacaacacattcgccaaggttatatggagcccctgatttccatcaaaaaggtttctataagtatattatttacatttttatacatgataactcttgcctttgtgttgaaaaaaaaaaagtctcttttttttcccccactcagcagttattggaaatagactgttcccatctgaaaccgtatcgtaatttgcatcaggaaacccaactgctgacattgaggacctgggtgtgttcaattatgattttgctggaggctgtccctcattttaatgctgcagctattgaaccaccttcctgaaacctagctgatacggaatagcagagacatgcctctcaacaccattagctttgcaaatggcttcatttcagtcaacgtcgacttctgctttggccaattgaaaaatgaaaattaaaggagagaagaaaaaaaacacagatgcacttaaaacatgaaaagaattatttatatgataaaaatatatttagcttttcaaagcacaagactgaatagaagtgctctttttatgctttctggagatgttactgttaaatgtctttctacatcaggcttaataaatctgtaatgacatttgatggattga

SEQ ID NO: 321184 - DNA, 494 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctctta

SEQ ID NO: 321185 - DNA, 474 bp, Homo sapiens
tgtttgttgttgacattaacattttctttaagagtatttcttcatctgtaaaatgaggataaaaattgtaaaattgtacctacttccagcctcatagaattgttttgatgattacatcagaaagcttgtaaaaaccttaggcctgtttcctgacatatactaaatgccccatgtgctaactgaggatgatcattgtaggaaaatttcatagactatgagggaaagccatgcctaaaataatctccagcttattaagaagtgcattcctttttgtttctttgttttatcttagattgagtctcactgtattgccagtctggagtgcagtggcgcaatctcagctcactgcaacctccacctcactgaggcaggagaaacgcttgaacctgggaggtggaggttgcggtgagctgagatcacaccattgcactccagcctgggcaacaagagcgaaattccatctcaaaaaaaaaa

SEQ ID NO: 321186 - DNA, 1306 bp, Homo sapiens
gcgtgagccacctctcctgtccaatttgcatttttttatttttttttttctgagacggagtctcagctttgtcgcccaggctgaagtgcagtggcgacaatctcagctcactgcaacctccacctcccgggttcagttttcctgcctcactctactaaaaatacaaaaattagccaggcatggtggcacatggctgtaatcccagctactggggaggctgaagcaggaaaatcgcttgaactgagagtcaaggcggaggtcgcggtaagccgagatcacaccattgcactgcagcctgggtgaagaaacaagcctccctctcaaaaaataaataaataaataaataatacctcctctgggataagtagtgctccgtctgtctcatgggcacatattagtgtcgtaatgccaaatactaaggttattgtaagcataaacattgaagataattgctagagaaaaatagactgaaaaagatgtaagaaaaatacacgtagatgagagtaacctgtctggtggaatcatgacattctaagcagtgaaggaatcaccaatgagaaaatctacaaaggctcaagatcaagtctatttaggtgaataaggcaatctagaaagaccttggaataataataccatttcctgaggaccttctaaataagtgccattaaagctttaaatacattaagactattcttcacaaaatctctgctaatagtaggtattaattgagactcaagaaatatcaaataacttatttatggctacacagctagatactaatggcaggagtgtttaattagaagtacttttactatcccaggttgcctcaaatgaaaacattttggacagcaatgtaaggtgaatagctgagcatgatggcacaagctatagccccagctacttgggaggctgaggcacaaggattgcttgagcaaatgagttgagtccagcatggacaactgtattcctgcagcctgcttgtattcctctcctcaaagtgctttttccttctctgccacatgactagtctgtgaattttccaaacttctacgctctgcttcccttttaaatatgttccaactttaagttatttcttgcttccatatctgattgtaggctgctagcatcagccaggccacatcttgaatgctttgctgcttagaaatttcttctgccagataccctgataccctaagtcatcactcttaagttcaaacttccacagattcctagggcctggacacaatgcacccaagctatttgctaaagcatgacatagatgtacctttattcctgttcccaataa

SEQ ID NO: 321187 - DNA, 4328 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcacctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321188 - DNA, 4797 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcacctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgattaaaaaaaaaaaaaagaaaaaaaaaaaaaaaaaaaaaaagagaaaaaaagagaaaaaaagagacggcgcacaaaaaagaacacagaggagccaacacagcgacacaagagaagacaaaggaagccaaaacaggcgagaaaaagagagagcacgcgaacaaaaacaagagagaaaaaacgagacgagagcaaaggagagacacccacacacccggaggacacaacgggaaccaacacagcagcgcaaccccgaggacgccacacacgaagaagcggagacaaagacgaggcgcacgaaaagagaaaaagaaaaaatcacgacaaaggagaaagacacgacgcgcgcggcgacacaccaaaacacggcggacgcagcggcgccgccacgaccccccccgacgcgagcgcggacaccgcgagcgacccgccgccgacacgccgcaacaccaccaccaaaacaccacgcgcagac

SEQ ID NO: 321189 - DNA, 4723 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcactttggcaggctgaggcgggcggatcattgaggctggtcttgaacccctgacctcaggtgattcacccgcctcagcctcccaaagtgctgggattccagatgtgagccagcgcacccagcctggccatcttttataaaaagatgaagatgtcagaattccctaataagattctggctctgttacccagactggagtgcaatgcatggcatgatctcagcacactgcaacctccatctcctgggctcaagccatcctcccacttcagtctcccaagtggctgggactacaggcacacgccaccacacctggctaatttttgtattttttgtagagacgaggtttcgccatgttacccaggctggtcttaaactcctgggttcaagtgatccacctgcctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321190 - DNA, 4044 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcacctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321191 - DNA, 3988 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcacctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321192 - DNA, 4559 bp, Homo sapiens
tgtttgttgttgacattaacattttctttaagagtatttcttcatctgtaaaatgaggataaaaattgtaaaattgtacctacttccagcctcatagaattgttttgatgattacatcagaaagcttgtaaaaaccttaggcctgtttcctgacatatactaaatgccccatgtgctaactgaggatgatcattgtaggaaaatttcatagactatgagggaaagccatgcctaaaataatctccagcttattaagaagtgcattcctttttgtttctttgttttatcttagattgagtctcactgtattgccagtctggagtgcagtggcgcaatctcagctcactgcaacctccacctcctgggttcaagcgatcctcctgcctcagcctcctgagtagctgggactacaggagcacaccaccacgcccagctaatttttgtgtttttagtagaggcggggtttcaccatgttgggcaggatggtctcaaactcctgacctcaggtgatccacccgcctcaacctcccagagtgctgggattacaggcgtgagctatccgtgcccagtcaatttttgtatttttagtagagatgaggtttcaccatattggtcaggctggtcttgaacccctgacctcaggtgattcacccgcctcagcctcccaaagtgctgggattccagatgtgagccagcgcacccagcctggccatcttttataaaaagatgaagatgtcagaattccctaataagattctggctctgttacccagactggagtgcaatgcatggcatgatctcagcacactgcaacctccatctcctgggctcaagccatcctcccacttcagtctcccaagtggctgggactacaggcacacgccaccacacctggctaatttttgtattttttgtagagacgaggtttcgccatgttacccaggctggtcttaaactcctgggttcaagtgatccacctgcctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321193 - DNA, 3115 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcactttggcaggctgaggcgggcggatcattgaggctggtcttgaacccctgacctcaggtgattcacccgcctcagcctcccaaagtgctgggattccagatgtgagccagcgcacccagcctggccatcttttataaaaagatgaagatgtcagaattccctaataagattctggctctgttacccagactggagtgcaatgcatggcatgatctcagcacactgcaacctccatctcctgggctcaagccatcctcccacttcagtctcccaagtggctgggactacaggcacacgccaccacacctggctaatttttgtattttttgtagagacgaggtttcgccatgttacccaggctggtcttaaactcctgggttcaagtgatccacctgggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321194 - DNA, 4277 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcacctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagccctctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 321195 - DNA, 3222 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcacctcggcctcccaaagtgctgggattgcaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatggtgaagccccatctctactaaaaatacaaaaattagccgggcatggtggcaagacacctgtaatcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaacaaacacaacaaaaaaacaatttttggggccgcctggaccctcgaaaagttttaaacacctcgcttggcgccgggcaccaaagttatgacatggcccaagccgccgccagagaaaccgggccggacttgtggctggttttccacataataagccggcgcagcgacgtttcgacaaatcgagtggtctgaggctatcgggtctgacgggagcaaggacgcttatcccgcgcccggcgcaggggccagacaaagaacgacggaaatgtgacgcaatacgacagagaagcgtcgacgcacacaacacacacacccacactacagatcagcagaacgac

SEQ ID NO: 321196 - DNA, 1982 bp, Homo sapiens
tagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcggtggctcacacctgtaagcccagcattttgggggttcaaggcaggaagatcagttgaggccgggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttaaaaaatagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcactttggcaggctgaggcgggcggatcattgaggtcaggagtttgagaccagcctggccaacgtggtgaaaccctgtctctactaaaaatacaaaaattagccaggcatggtggcacatggctgtaatcccagctactggggaggctgaagcaggaaaatcgcttgaactgagagtcaaggcggaggtcgcggtaagccgagatcacaccattgcactgcagcctgggtgaagaaacaagcctccctctcaaaaaataaataaataaataaataatacctcctctgggataagtagtgctccgtctgtctcatgggcacatattagtgtcgtaatgccaaatactaaggttattgtaagcataaacattgaagataattgctagagaaaaatagactgaaaaagatgtaagaaaaatacacgtagatgagagtaacctgtctggtggaatcatgacattctaagcagtgaaggaatcaccaatgagaaaatctacaaaggctcaagatcaagtctatttaggtgaataaggcaatctagaaagaccttggaataataataccatttcctgaggaccttctaaataagtgccattaaagctttaaatacattaagactattcttcacaaaatctctgctaatagtaggtattaattgagactcaagaaatatcaaataacttatttatggctacacagctagatactaatggcaggagtgtttaattagaagtacttttactatcccaggttgcctcaaatgaaaacattttggacagcaatgtaaggtgaatagctgagcatgatggcacaagctatagccccagctacttgggaggctgaggcacaaggattgcttgagcaaatgagttgagtccagcatggacaactgtattcctgcagcctgcttgtattcctctcctcaaagtgctttttccttctctgccacatgactagtctgtgaattttccaaacttctacgctctgcttcccttttaaatatgttccaactttaagttatttcttgcttccatatctgattgtaggctgctagcatcagccaggccacatcttgaatgctttgctgcttagaaatttcttctgccagataccctgataccctaagtcatcactcttaagttcaaacttccacagattcctagggcctggacacaatgcacccaagctatttgctaaagcatgacatagatgtacctttattcctgttcccaataa

SEQ ID NO: 321197 - DNA, 194 bp, Homo sapiens
tccgctttcttcctgcagcgtgaagacacagcgcatctccccgctgtaggcttcctcccacagaacccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321198 - DNA, 653 bp, Homo sapiens
  misc_feature (601)..(601): n is a, c, g, or t
ggttgagaccagcctgaccaacatggtgtaaaaccccatctctactaggaatacagaaaaattagctgggtgtggtggtaggtgcctgtggttccagctgctcaggaggctgaagcacaggaatcgcttgaacccaggaggtggaggttggagtgagccgagatcatgctactgcactctccagcctgggctacagagtgagactctcaaaaaaaaaataataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctcccctggggcccagagcatggggagncgcccacaaggcaggctgtccatgcagggtactaatggggatagtgaatgaa

SEQ ID NO: 321199 - DNA, 2087 bp, Homo sapiens
  misc_feature (22)..(22): n is a, c, g, or t
aaaaaaaaaaaaaaaaaaaaancaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321200 - DNA, 2449 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321201 - DNA, 2419 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321202 - DNA, 2352 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321203 - DNA, 2341 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321204 - DNA, 2515 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttgggtgagtggcttgggctggccccttccctctgcctcctcctggtgccccgacaccggcccagccctcagcaccctgtgtctctcacagcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321205 - DNA, 2060 bp, Homo sapiens
agaatacgcaagacaggcgcgtgttatcggacgagctgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321206 - DNA, 3100 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagaggtgggcggggaggtggagtctcgtcggcctgccccagcaaggggaggcggcgggccctgaggaagatggacccacatggccactctatcaacctgtgtccccatgttccctgcttttttgttttgtttttttgaggtggagtctcactctttggcccaggctggagtgcagtgatgcgacctcagctgactgcaacctctacctcccgggttcaaacaattgtcttgtctcagcctcccaagtagctgggattacaggtgtgcaccaccatgcctggctaatttttagtagagatggggtttcaccatgttggcctggatggtctcgaactcctgacctcagatgatccacctgccttggcctcccaaagtgctgggattacaggcatgagccaccacacccggccatctcctgcctttttttttttggatggagtttcactcttgttgccgagatcatgctactgcactctccagcctgggctacagagtgagactctcaaaaaaaaaataataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321207 - DNA, 2448 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccgagctggtggtagccaaaaggtcagcggtcatagcagctggctagtgggctatgatgattgactgtgactcatacaataatgtgatcgcaccaagaaagataaaaaaaaggcggcgcaaagttctgagggcagtgtacg

SEQ ID NO: 321208 - DNA, 2428 bp, Homo sapiens
  misc_feature (2)..(2): n is a, c, g, or t
  misc_feature (500)..(500): n is a, c, g, or t
  misc_feature (502)..(503): n is a, c, g, or t
  misc_feature (506)..(506): n is a, c, g, or t
  misc_feature (510)..(511): n is a, c, g, or t
  misc_feature (514)..(514): n is a, c, g, or t
  misc_feature (517)..(517): n is a, c, g, or t
  misc_feature (524)..(524): n is a, c, g, or t
anctataggactctcagaggcaccaaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcngnnccncaanngcnccnccaccgngcgctcctgtgcgggaaagagaccatggtgaccagcaccacagagcccagtcgctacatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321209 - DNA, 2005 bp, Homo sapiens
gtcttctgtggtttttttatttgttttaattatgtgtaaagacagggtctttatatgttgcccaggctggttgcgaactcctgggctcaagtgatcctcctgccttggcctttcaaactgctgggattacaggcatgaaccactgcacccagctgatctcctgtctcttgagagttgatatctagctccacctcctggcactccctagtcccttccctgaccccaggggcttacagaacccactgttcctctttcaaggacaggaatgaaggatgctgatgttgagagaacctgggaggaaggcttgctctcatctttcccagcatggcttggtggggggccacagctggattgagctattttggaagaggcagacctggtggatcctaagtgccccactggtggtgcctgtgtgtctccgcaccgcagagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321210 - DNA, 1447 bp, Homo sapiens
tactttgggtacgtgtgactgtgtgggtcagtggtgactgttgggtgcggtgactgtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321211 - DNA, 1879 bp, Homo sapiens
  misc_feature (2)..(2): n is a, c, g, or t
  misc_feature (500)..(500): n is a, c, g, or t
  misc_feature (502)..(503): n is a, c, g, or t
  misc_feature (506)..(506): n is a, c, g, or t
  misc_feature (510)..(511): n is a, c, g, or t
  misc_feature (514)..(514): n is a, c, g, or t
  misc_feature (517)..(517): n is a, c, g, or t
  misc_feature (524)..(524): n is a, c, g, or t
anctataggactctcagaggcaccaaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcngnnccncaanngcnccnccaccgngcgctcctgtgcgggaaagagaccatggtgaccagcaccacagagcccagtcgctacgagtacctcatggagctgatgcccgtaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321212 - DNA, 1597 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgagaggcccacgacatgtcaccccgagcggcagcctgtgagagacaatgcgccctagagagaagcgctcatccgagttgccgagagccga

SEQ ID NO: 321213 - DNA, 1869 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321214 - DNA, 1523 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcccccagccctgtccctgccacccctcctagtggggactagtgaatgacttgacctgtgacctcaatacaataaatgtgatcccccacccaaa

SEQ ID NO: 321215 - DNA, 1399 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgagcactgcccaccgaccttccagcatctccgctttggaaagggtaccgag

SEQ ID NO: 321216 - DNA, 1553 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgagcactgcccaccgaccttccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccaca

SEQ ID NO: 321217 - DNA, 1335 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcagccctcctagtggggactagtgaatgacttgacctgtgacctcaatacaataaatgtgatcccccacccaaa

SEQ ID NO: 321218 - DNA, 894 bp, Homo sapiens
cgacccacgcgtcgcggacgcgtgggtcgacccacgcgtccaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321219 - DNA, 933 bp, Homo sapiens
  misc_feature (2)..(2): n is a, c, g, or t
anctataggactctcagaggcaccaaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgacacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321220 - DNA, 869 bp, Homo sapiens
gcccaggctggagtgcagtggcatgatcttggctcactgcagtctccacctcccgggttcaagcgattctcctgcctcagcctcctgagtagctgggattacaggcacatgccaccacatccggctaatttttcgtatttttagtagagatggagtttcatcgtgttggccaggctggtctcaaactcatcacctcaggtgacccacccgcctcggcctcctgagtagctgggcttcatggcactgaacttgtcgtggtcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321221 - DNA, 1553 bp, Homo sapiens
  misc_feature (2)..(2): n is a, c, g, or t
  misc_feature (500)..(500): n is a, c, g, or t
  misc_feature (502)..(503): n is a, c, g, or t
  misc_feature (506)..(506): n is a, c, g, or t
  misc_feature (510)..(511): n is a, c, g, or t
  misc_feature (514)..(514): n is a, c, g, or t
  misc_feature (517)..(517): n is a, c, g, or t
  misc_feature (524)..(524): n is a, c, g, or t
anctataggactctcagaggcaccaaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcngnnccncaanngcnccnccaccgngcgctcctgtgcgggaaagagaccatggtgaccagcaccacagagcccagtcgctacatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgagcactgcccaccgaccttccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccaca

SEQ ID NO: 321222 - DNA, 308 bp, Homo sapiens
cgacccacgcgtcgcggacgcgtgggtcgacccacgcgtccaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtcagccttactgcctgacgtcgccagagtg

SEQ ID NO: 321223 - DNA, 2428 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321224 - DNA, 2105 bp, Homo sapiens
cgacccacgcgtcgcggacgcgtgggtcgacccacgcgtccaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321225 - DNA, 2227 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321226 - DNA, 2353 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgacacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321227 - DNA, 2685 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagaggtgggcggggaggtggagtctcgtcggcctgccccagcaaggggaggcggcgggccctgaggaagatggacccacatggccactctatcaacctgtgtccccatgttccctgcttttttgttttgtttttttgaggtggagtctcactctttggcccaggctggagtgcagtgatgcgacctcagctgactgcaacctctacctcccgggttcaaacaattgtcttgtctcagcctcccaagtagctgggattacagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321228 - DNA, 2206 bp, Homo sapiens
cgacccacgcgtcgcggacgcgtgggtcgacccacgcgtccaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccatttcccggtagtgctccgctggtggggatgggaggacagaggtggtatttggtggagaaggcgcttacctgccctgggctgagcttcctgtaccccgcagaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321229 - DNA, 3121 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagaggtgggcggggaggtggagtctcgtcggcctgccccagcaaggggaggcggcgggccctgaggaagatggacccacatggccactctatcaacctgtgtccccatgttccctgcttttttgttttgtttttttgaggtggagtctcactctttggcccaggctggagtgcagtgatgcgacctcagctgactgcaacctctacctcccgggttcaaacaattgtcttgtctcagcctcccaagtagctgggattacaggtgtgcaccaccatgcctggctaatttttagtagagatggggtttcaccatgttggcctggatggtctcgaactcctgacctcagatgatccacctgccttggcctcccaaagtgctgggattacaggcatgagccaccacacccggccatctcctgcctttttttttttggatggagtttcactcttgttgccgagatcatgctactgcactctccagcctgggctacagagtgagactctcaaaaaaaaaataataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321230 - DNA, 2539 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctacctaagaacagctaaaaagagcacacccgtctatgtagcaaaatagtgggaagatttataggtagaggcgaaaaccctacgagcctggtgatagctggtggtccagatagaaatcttagttcaactttaaatttgcccaagaaccctctaaattccccttgtaaatttaactgttagtcaaagaggaaacagtcttgtgaacactagaaaaaactttgtagagagagtaacaatttacacccatagtaggctaaagcagcaccattaagacaggtcaagtcaaaacatacgttaaaatccaaattatgattctaaccatgccattttacctatagagatagtgtagtaatgaaaattctctatctaccgatatcggttcttaaaaaataaaaaaacaaaatggggggcgaattacctgggggcggtagagattagcgcagggtcaaaacggga

SEQ ID NO: 321231 - DNA, 2085 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcgtagtcagatcgccctaacacagtttctcagttcccagccgcgtagtcaat

SEQ ID NO: 321232 - DNA, 1535 bp, Homo sapiens
aactcaggggcgagctgcggtggtggcggcggctgctgctgctgctgctgctgctgctgctgctggaagcccgatggggtcatacgatcccgaggaggtgaaatcggttcggacttgatgctgatgttttggttggtattaatggataaattggaaccctgagataactgccctccagcaacaagagagctgagggctgcttgtcctagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321233 - DNA, 1151 bp, Homo sapiens
ggcatagcgattctagaggatacccgttcgacgggtgtctaggggcgccagtcaggtacacgtaccgggtgcgagcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321234 - DNA, 1032 bp, Homo sapiens
cgacccacgcgtcgcggacgcgtgggtcgacccacgcgtcgcccacgcgtccgggacgcgtgggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321235 - DNA, 1697 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321236 - DNA, 1520 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgttctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 321237 - DNA, 1398 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcagccctcctcagtgggcgacgagggcacaggcggctgctcctccttgggctccgtcaagtcaggggcagaaggtgctggaaggtcggtgggcagtgcctcggaccggtacttgtccctgatggcggcccagacgcg

SEQ ID NO: 321238 - DNA, 1361 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggtgtgagtgagccaacttctcaggcctgatccttaaccctgtgtccactctgccttgtcttgtatttgatgtgactacatctttctcccctctttcc

SEQ ID NO: 321239 - DNA, 1178 bp, Homo sapiens
cggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgcttccaggcccacagagcgagctgcggctgatgccttcaggacgatcagagaaagggatctctaga

SEQ ID NO: 321240 - DNA, 780 bp, Homo sapiens
cgacccacgcgtcgcggacgcgtgggtcgacccacgcgtccaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggtgagccttttctctgttcatccatcagatgtttattgaacactgctcagtgccaggccctgtctgtgtgaccaagatactacctctgctggctcccctttgagtgggcagaaacaagctcagaagtcagtggtcagtgttatggccccgggcagctggaggagcccagagtcgtcctcctcccaagcctcggggtcagagaaggctcctccaaggaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaagtacgtgggtgacagtacccctcccatcacccc

SEQ ID NO: 321241 - DNA, 282 bp, Homo sapiens
ggagatgctgcggacagtgaaggaggaagctgagaagccagagagagaggccaaagagcagcaccagaagctgtgggaaggtatggcagaaatggccaaggactcaccttcagtcctgggtgggagcaggtctgggcctaggagtctcccgctcattatctgttgtcagtttcagcaggtttttgatcatgctgcccatcgccttgtgtgctttgaggttcgcttggattgtggcatatgtcaggagcctcctttttaaaaattgtttaaataatttgtttt

SEQ ID NO: 321242 - DNA, 313 bp, Homo sapiens
aaagaggtagaaagcttatttaaaggcatactggtggatatgttctcaaatatggagagagatatggacatctaggtacatgaaacttaaagttctctaattacattcaaccccaaaagactttgccatgacacattataataaaactgtcagtaaatcaaagacacagcgaattttgaaagcagcaaaagaaaaaaacatatacatgggaacctcactgaagctatcagtatatttctcaacagaaaccttgcaggccagaaaataatagaattatatatttaagatgctgaaataaaaagcaaaaaaaaaa

SEQ ID NO: 321243 - DNA, 544 bp, Homo sapiens
ccccaacacaacttttccccttcacctctcagtacactatataatttgcttattgtttttattagggaattgcctccccctgccccctgcttttaagcatcagctccatgaggacaaaaatttttattttgtccacagctgtctccccagtgcctgaaactgtccctggcactttgctccataagccatttttggtgtaatgctcacaaacattttgttcaataagcaaaagtaaagaacagccccaaactgtgtgactatggggcattcctgttaaatccagccccctcctcccccataccccaagagggcaggcccttcttcccacagaggtggggctatcaaaagaaattgggaggctgggtgtgagctggagaagccacaaggggcctggaggcagagctgtgcagaaaataggtcgcagtcctagaactggcaggtcatgacagctggacatgggtgaaggggctttcggccttagccctccactccaaatttggaagcacggaggaagttgacgacatgtgactgggaaagaagcggc

SEQ ID NO: 321244 - DNA, 513 bp, Homo sapiens
cagaaaattggtaccggggaagttgggcattgctattagaggtactgagaggtacttagagaaagaagaaataaaaactaaaagagaaaacaagttttcctgtattaggctgtgtcatcccaaaaagcagtgacagacacagcccaggcccaggcaaggtcctgataacactatctaaaaagtcagaacccaaaaggaatgttctcttgagactctcccagcactccccaacataaggataagaaaaacaaaattcctcttttagccctttacccactccccataaatattttgcaagttttgtaagttccggtttctccttcaatgcagctgcaaggtcacaagctatgctggatattacgagacctgtcactatttaattaactgtccttgttctgcttctgtaagcttgcttatgaaaatcaagccctttctttgttctaggctcagctttttggatatgaatccactgagccattgtacactttaataaaaatcctcctgtaataccca

SEQ ID NO: 321245 - DNA, 559 bp, Homo sapiens
ttctcagcagttgttagaacaagtagctggaaagtctggatatggaagattcaaacaatactatcaatcaacttgatcaaattgatattacagaacactgcattcaacaacagcagggtgtacattctttttaagtgcacatggggtattcaccatgatagactatatgctgggttataaaagcttctcaacaaatttaaaaggattaaaattatatgaggtctgtttgttgaccaccatggaattgggtaagaagtcaaaagcattaagatatcaagaaaattcccaaatacttggaaattaaatatcacacttctaaataagccatagatcaaagaagaaatcaccaggaaattagaatttatttgaaccttattgataataaaaacacaatatatcccagtgtatgggatgaagctaaagcagtgcttagatggaaatgtgtaggttaaatgcttatgttagaaaagaagaaagttctaaaatcagtgatctagcttccacattaagaagctaacaacaacaacaaaaatactaaccttaagtacgtagaaaaaag

SEQ ID NO: 321246 - DNA, 426 bp, Homo sapiens
agatgcacaatagaattgtaacaaaaaacatttggggcccggaaaaggaaaaaaaaaaattttgggggggggggttttttaaaattttcaaaaatttaaaattttgtggggggtttgaaattttccccccccccccaaatttttttttggttttgggttaaaaaaaaacaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactt

SEQ ID NO: 321247 - DNA, 1168 bp, Homo sapiens
cactccccgccccctaccctgtcttgcgtctgtgtgcaggtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactt

SEQ ID NO: 321248 - DNA, 1515 bp, Homo sapiens
gtcttttttttgcctgtccaccatctccctattaccctttggtcgagagggaaagcagaagaagtctgctggtcacagcggggcacctcgaggagaggacgactaggagcacacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctgggaaaatggtgggctttcgggaaggagggggcgaccgggaagcggcggagtcgggagagccggagagcctctgggaaagcgcaaggttgaggacctggcccccgaatcaggaaaaggcaggtattggaacccacggcctgggtgttagtccagccgcttagtattctgactctattctgcctttcttgtctcctaagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactt

SEQ ID NO: 321249 - DNA, 1192 bp, Homo sapiens
gtcttttttttgcctgtccaccatctccctattaccctttggtcgagagggaaagcagaagaagtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactt

SEQ ID NO: 321250 - DNA, 1185 bp, Homo sapiens
ccgagactagatgcggaccgtctctggcaaccaggaaaaggcaaatacaaagagaggtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactt

SEQ ID NO: 321251 - DNA, 1427 bp, Homo sapiens
ccgagactagatgcggaccgtctctggcaaccaggaaaaggcaaatacaaagagaggtctgctggtcacagcggggcacctcgaggagaggacgactaggagcacacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctgggaaaatggtgggctttcgggaaggagggggcgaccgggaagcggcggagtcgggagagccggagagcctctgggaaagcgcaaggttgaggacctggcccccgaatcaggaaaagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactt

SEQ ID NO: 321252 - DNA, 851 bp, Homo sapiens
tctttaaggtaactctaaaattaatggaatgtttttgaatgcctaaacttactggagccaccttattgagtgatataggctttctcataaactttcttggacaattttataggagaccaaatgcctttcctccttctcccagctcggcccttcaaaaagaaaccaagccacaccaaaactttcaaaaaaatctaagaaggcaaagaaatttgtggatcaaataagtaccatttgtttactgctatgacatttaagtcatatttataataaggattcatttttatgtacccttatatagcatttatataaaatttataggacatttctgttttccagaacccaatgtataaattacattgattgaaaagcctgttgctgttggttttggtttggctttgagggtggtttacatatttgttatatctaccttttaaccaaaagtcaagaattcaaccagcaattaaataataattcctgtggtaaagcactttcccttctatattgattttctttatgacctgttttccaggtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgtaagtaactggggacttacaggagaattgaacagttgtttctgctgactcagtaaaaagtcttcattttataatttgtggcctgcatgcttgtaaattaaaatgcattgagttgtcaagta

SEQ ID NO: 321253 - DNA, 2167 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggccgttttctcgacccggtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtgaggtgccccaggaaagagtttcccaagccctggctgccctcccccggcgcgctgggtcccggtgaggtctctaggtaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaagggtttcttttttaattgatgccaaagagttccaatattgaacatcttaagtctgttacttggattacggattgagtttggagcttactcagaggactacaggagagtatccaggaagtagcaagaaatgtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321254 - DNA, 1173 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaagggtttcttttttaattgatgccaaagagttccaatattgaacatcttaagtctgttacttggattacggattgagtttggagcttactcagaggactacaggagagtatccaggaagtagcaagaaatgtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattagagaattgcttgaacctgggaggtggaggttgcagtgggctaagatggcaccactgcactccagcctgggtgagagagcaagaccctgcctcagaaaaaaaaaaaaaaaaaatctaagacctgtatatcaaattttgagtttgtttcttcttttgtacctcaatagttacatttatcaaaaagctgagctgttgtaaaattgtggaattcacattggatattcaaaaacatttcttactattaatgacaaccaatagttatggatatttcattttaaacatggttataaaatgtaaacatgacactaataagctcaataaatgtttggcctgtctagt

SEQ ID NO: 321255 - DNA, 865 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtaaagatcaaattttataaatttacttgtttgtttatacaaggaaaaataacttcatatattgaatatattcaaaagtttaagcatttagttgtattgccctgttaagttggcatagcaaataaatgcttttcttttcctcattttattctttgtgtttcctaacctatagcactgtgctgggcacagaatggacttcagttaagtttttgatgtagaaatgttttattattctacttaaaatctccttaaaaataattatgcatattacatcaatgttataatgtttaaacatagatttttttacatgcattctttttttcctgaaagaaaatattttttatattctttaggcgcgaatgtgtgtttaaaaaaaataaaaccttggagtaaagaaaaaaaaca

SEQ ID NO: 321256 - DNA, 831 bp, Homo sapiens
aaaaatcgagccggggggttccctggtccccggcgatggggcggggagcgctgcgccgggggagggggcgggcgcggcggcgcgggccccgccgaggggggacacctggctgaggcacagctgccgccgtgcctttccgcgcgagcccagagctccgatccctgcgcgggctcgagagctcgccccgaacgggggtcttcctcctccgccgttgacaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttaccttggataacttactgtaccttcctcatgggaaaaaggtaaattacacagggtgtaataccctcatggaatccatactcaaaaggggcaaaaaaatgtgagctaaaacttgcgagcatagatttggactctagtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgtaagtaactggggacttacaggagaattgaacagttgtttctgctgactcagtaaaaagtcttcattttataatttgtggcctgcatgcttgtaaattaaaatgcattgagttgtcaagta

SEQ ID NO: 321257 - DNA, 448 bp, Homo sapiens
cggccgctccttgacaggaggactggacgcgcgcccctcccccatttccgaaccgggccgccttttctcgccgttttctcgacccggtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtgaggtgccccaggaaagagtttcccaagccctggctgccctcccccggcgcgctgggtcccggtgaggtctctaggtaggtaggactggccgcggctcgcgcttccaagatggggcaggggcaggcttttgaggttgtagcgggctcttaggaaagatgctggactttagcttctttctggggatttttgtcatttgctctcgcagcgttgt

SEQ ID NO: 321258 - DNA, 1698 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321259 - DNA, 1444 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattagagaattgcttgaacctgggaggtggaggttgcagtgggctaagatggcaccactgcactccagcctgggtgagagagcaagaccctgcctcagaaaaaaaaaaaaaaaaaatctaagacctgtatatcaaattttgagtttgtttcttcttttgtacctcaatagttacatttatcaaaaagctgagctgttgtaaaattgtggaattcacattggatattcaaaaacatttcttactattaatgacaaccaatagttatggatatttcattttaaacatggttataaaatgtaaacatgacactaataagctcaataaatgtttggcctgtctagtataataaatatgtttttgtcagaatttgacccatttatgatgtaagcaaaaatgatatgtcttaatccatttgtctcacacactaattttataatttaaaagagcaatagtagtttcattcagaaagacaggtttaaggccaggtgcagtggctcacacccataatcccagcattttggatcacctgaggtcaggagttcaagaccagcctggccaaggtggtgaaaccccgtctctactaaaaatacaaacgtggcaggcgcgtgtaatcccatctacttgggaggctgagacaggagaatcgcttgaacccggggggcggaggttgcagtgaatcgagatcccaccactgcactccagcctgcgcgacagagtgagactccgtttcaaaaaaaaaaa

SEQ ID NO: 321260 - DNA, 1822 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcatttcatgtttttcccttgatgtgaagtcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321261 - DNA, 1748 bp, Homo sapiens
ggcggggttggctctaacgaatttgaatgaggagcctcagcgctttcggcgccattttcgagtgatgcctgatctcatcaatctagcgggagagacaggataactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321262 - DNA, 1853 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaagtgtataaagccaaatgtcccgtttaaagtttgacatttgcaatagcattctatttaaaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321263 - DNA, 1889 bp, Homo sapiens
cggccgctccttgacaggaggactggacgcgcgcccctcccccatttccgaaccgggccgccttttctcgccgttttctcgacccggtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtgaggtgccccaggaaagagtttcccaagccctggctgccctcccccggcgcgctgggtcccggtgaggtctctaggtaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321264 - DNA, 1115 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctaggcctactctaggtgcggtacttcactatagtttataaaagatggtccctgtcagcaaagaactgtaacctgtatgagaatattatactaacatacaagaaacaagtagagaataatggaatgtaaactctggcttgctaacttaagtgtggtagaagcttgaaggaaatgtggacttaaacttatcagagaagacttataagaggatatgaaaggtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgtaagtaactggggacttacaggagaattgaacagttgtttctgctgactcagtaaaaagtcttcattttataatttgtggcctgcatgcttgtaaattaaaatgcattgagttgtcaagta

SEQ ID NO: 321265 - DNA, 838 bp, Homo sapiens
tcaagcttctaacgatgtacggggacatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321266 - DNA, 1017 bp, Homo sapiens
gggaggtcatgaagtattctgagcaggagagtaagaaaaataacttctgaaatacgtgtactggtcagaatttgcttaaagagagaaatctggccgtggtggctcacacctgtaatcccagcactttgggaggctgaggctggcgaatcaccagagttcaagagttcaagaccagcctgggcaacatggcgagaccccatctctactaaaaatacaaaaattagccgtgcatggtggtgcacgcctgtagtccctgctacgtggtggggggctgaggcaggagaattgcttgaacctgggaggtggaggttgcagtgggctaagatggcaccactgcactccagcctgggtgagagagcaagaccctgcctcagaaaaaaaaaaaaaaaaaatctaagacctgtatatcaaattttgagtttgtttcttcttttgtacctcaatagttacatttatcaaaaagctgagctgttgtaaaattgtggaattcacattggatattcaaaaacatttcttactattaatgacaaccaatagttatggatatttcattttaaacatggttataaaatgtaaacatgacactaataagctcaataaatgtttggcctgtctagtataataaatatgtttttgtcagaatttgacccatttatgatgtaagcaaaaatgatatgtcttaatccatttgtctcacacactaattttataatttaaaagagcaatagtagtttcattcagaaagacaggtttaaggccaggtgcagtggctcacacccataatcccagcattttggatcacctgaggtcaggagttcaagaccagcctggccaaggtggtgaaaccccgtctctactaaaaatacaaacgtggcaggcgcgtgtaatcccatctacttgggaggctgagacaggagaatcgcttgaacccggggggcggaggttgcagtgaatcgagatcccaccactgcactccagcctgcgcgacagagtgagactccgtttcaaaaaaaaaaa

SEQ ID NO: 321267 - DNA, 909 bp, Homo sapiens
cggccgctccttgacaggaggactggacgcgcgcccctcccccatttccgaaccgggccgccttttctcgccgttttctcgacccggtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtgaggtgccccaggaaagagtttcccaagccctggctgccctcccccggcgcgctgggtcccggtgaggtctctaggtaggttttgacctgtagcagagaaccaattctggagaacagcctcacttctttgattgaatacttacataatgcattggaacatgacatgagattaagtgtataaagccaaatgtcccgtttaaagtttgacatttgcaatagcattctatttaaaaggtaatcatatagttgctttctggtcaccttcattaaaatcactcctgatcactctcactcttaatattttcctgtgccaatcacagtaaattcagaatattagttccctggtaatattactaaaaaaagctttgtcatagtatgtgtctagttatctgaaaaaataaatgagcccacaacctttcttggcattgtgaagtcaagcatattcagccataaattgaggttacttttttgttgttgttgactaatgctagaggtttttaaaaaaaagtttatgtaatttaacagataacatattaattactgttacctcccctaactaaaacatgagttacataatcctctctattgaaagcacctcatttttaatcattacttactgcttagttgcctgcaaaccacctgtatgagaataacctagaatttaaaaaataaa

SEQ ID NO: 321268 - DNA, 1793 bp, Homo sapiens
ggcggggttggctctaacgaatttgaatgaggagcctcagcgctttcggcgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 321269 - DNA, 696 bp, Homo sapiens
  misc_feature (2)..(2): n is a, c, g, or t
  misc_feature (634)..(634): n is a, c, g, or t
  misc_feature (646)..(646): n is a, c, g, or t
  misc_feature (648)..(648): n is a, c, g, or t
anagaatcgcttgaacctggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttccaatgtnttccagataaangntaatggatggtgtattccaggttgttgggccggcaatggccatgcgtc

SEQ ID NO: 321270 - DNA, 682 bp, Homo sapiens
  misc_feature (2)..(2): n is a, c, g, or t
anagaatcgcttgaacctggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttcctgacaatatattaacactgcacataccacgtattgataattaatattattttat

SEQ ID NO: 321271 - DNA, 576 bp, Homo sapiens
ctgcctcctctgtgggctgacataacattttgtacccacaactgctgcagcacttgagttctgctgagcttgtttgcacattcaccaccttccttgggctctgaccactcagtgtgctgttcatctttgtattgctgacacctaacccccgccttgacccagtgtactcagtactgaccagattcttgaatcctgtgctatgatatccatgtggaagttaggcattggtacccacacagggaatgtattaaactgctttttaaatcaagagtgatcatcttctctaatcacaggtaacatcctcaagcaaatcagaatgagagcacccattcaggaaacctgaacagggaaggtgaacccctgtcctgaccaaaattgggtatgtttagagggcttttcttgtattccttctgctctaagtcctattattctgatcctgaaggtgcagacagcggcatgtaaggaaaattgatcagtgaagtagcaactaatggcatctagcatgacttacgaagccatataagatgtgtgattgaaagtcaaaagcttggtacctagaacccctgaaaatctaaa

SEQ ID NO: 321272 - DNA, 1143 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321273 - DNA, 1030 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321274 - DNA, 1153 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggtaacatcctcaagcaaatcagaatgagagcacccattcaggaaacctgaacagggaaggtgaacccctgtcctgaccaaaattgggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321275 - DNA, 1049 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321276 - DNA, 677 bp, Homo sapiens
tctctctctcgtgcctttcattccatttcccattctcctgccctccccattcccatcccacttccaaccaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321277 - DNA, 1080 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaaaaaagtcgacgcggccgcaatttagtagtagtagtagtagtagtag

SEQ ID NO: 321278 - DNA, 1025 bp, Homo sapiens
  misc_feature (1002)..(1002): n is a, c, g, or t
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagattgtnggtgccctgaagattgttggtgg

SEQ ID NO: 321279 - DNA, 973 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaacaacacaaaaaaaaactcggagcgacatcaattgccgggtgcgggaacacacacggctccccgacaatggcccatggcccatactggtttcctgaccccagttttcttctcccaccggcaaaaccgcgggccctataggagccattaattcgataagcggtaccga

SEQ ID NO: 321280 - DNA, 1049 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaacaacacaaaaaaaaactcggagcgacatcaattgccgggtgcgggaacacacacggctccccgacaatggcccatggcccatactggtttcctgaccccagttttcttctcccaccggcaaaaccgcgggccctataggagccattaattcgataagcggtaccga

SEQ ID NO: 321281 - DNA, 951 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321282 - DNA, 562 bp, Homo sapiens
cggcggatgatggccgcggtccgcgatggggtgtggatggagtttcggccgcatctggctttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321283 - DNA, 906 bp, Homo sapiens
  misc_feature (2)..(2): n is a, c, g, or t
anagaatcgcttgaacctggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321284 - DNA, 564 bp, Homo sapiens
ggatggggggggggagggggggtggcggaggggagggggggggggtgcggccgcatcgggctttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321285 - DNA, 861 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321286 - DNA, 1026 bp, Homo sapiens
cggcggatgatggccgcggtccgcgatggggtgtggatggagtttcggccgcatctggctttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtgggaaggactttaactcctgttttctggtggtttcctttgttgtacttttatctttctggcctttgcttcaaagttcaatatcatgggtcttgtgctttgcatctcacattgcatttcacactccaaggcctatggaatcttgtgcagattacaaatatccctattctctaaagtatgctggactaataattgttaaataattgacttgtaacatgtgcttgccagctgactttcttctctaaggcatcctaaaactagggaaatgagactactggattctattcccagctctgccacttgatgctatatgaccctgggctgcccacatttcttctccatgcctattattttcctttcctcacaaaaacctcatgggcttggctgcatatgcattgggggtggaccattgaaaattctgttaaaaatgtgaaattaaacttctgattttctccttcccacaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321287 - DNA, 646 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321288 - DNA, 320 bp, Homo sapiens
cggcggatgatggccgcggtccgcgatggggtgtggatggagtttcggccgcatctggctttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttgtgtagcggtggaggattaagagagtgtctcagctagc

SEQ ID NO: 321289 - DNA, 328 bp, Homo sapiens
cggcggatgatggccgcggtccgcgatggggtgtggatggagtttcggccgcatctggctttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttgcctgagggcgtctgcggggggtgctgtttggccgcgcgcggggca

SEQ ID NO: 321290 - DNA, 726 bp, Homo sapiens
  misc_feature (710)..(710): n is a, c, g, or t
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccagttttgtttgaaagactgtaccctcntaagcagtgaggagat

SEQ ID NO: 321291 - DNA, 815 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaatagagggtgtctttccacagtaccgatccttgtaggccttttgggcccagtcgactttagaactgggcaagtttagcatggcggccgaaatctgggcccacttggcccaatccctctttggcgggctgtattaccaattaactggccggcgttacacaacgtggggacttgggacccttggtgtacgccccttgggct

SEQ ID NO: 321292 - DNA, 380 bp, Homo sapiens
cattacatggcttcatctacctccaggcttctccccaggtaacactgaacctacaaccttagactttagggccatatgaaacctaagaagtgacattctccaagcccctgattttctggttggagagattagagcgtagacattacctgcagcacagagagcagtgggggacaccctcctgtcccagcgttgagcaccctgttccccactggcttcgtgtagcagagtgctaaagccattgactatgcataaaaggattgctgttgatgtaggaacaacagagcaaatcgagtgtcatctttatgatgacgcttagggtttgcaggtgggacgctctgacctgtagccacttgcctcagctcctcctttactctgactgg

SEQ ID NO: 321293 - DNA, 803 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321294 - DNA, 951 bp, Homo sapiens
  misc_feature (2)..(2): n is a, c, g, or t
anagaatcgcttgaacctggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaggttagtcacatcaatcacctgagagttcagcagcatccaacagtgttagttccacgtgttaacttcctgaagaaccacaggcttgcacatccaattatgcttcctgtccctttcctcccccgtgcggaatcaacttcagctcatcaatggggtaggaaagcctccttatttcgcaccctccatgctccaggcatccagggaaatgcccctgccacccctatctcccttgagttcttagggcttcctcctctagcaaggagatttccctttctagtcccgggggcagcggcacagcccggctctgacctcgcgggagc

SEQ ID NO: 321295 - DNA, 1067 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321296 - DNA, 1011 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacagatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321297 - DNA, 879 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321298 - DNA, 615 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321299 - DNA, 828 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaaccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcta

SEQ ID NO: 321300 - DNA, 925 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaaaaaaaacaaacacaccacaaacaaaaacaacaacaaaaaaaggggggggccaaaaaaaatccccgggggggccccaattagccccacccttttttgtgcaaaagggggccgctcaagg

SEQ ID NO: 321301 - DNA, 917 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaaaaaacaaagggggggcggctaaagatattccatg

SEQ ID NO: 321302 - DNA, 665 bp, Homo sapiens
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaaaaaagtcgacgcggccgcaatttagtagtagtagtagtagtagtag

SEQ ID NO: 321303 - DNA, 687 bp, Homo sapiens
ccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacagtatccttgcaaagattttttttgttcttctgtgggagtttgccagcggatcacattacatggcttaatttaccttcaggctttttccccaggtttgtttaagaagactgtcccaaaggcccaagggaggaggagaaggaaatttactgcg

SEQ ID NO: 321304 - DNA, 739 bp, Homo sapiens
  misc_feature (623)..(623): n is a, c, g, or t
  misc_feature (625)..(625): n is a, c, g, or t
caagcataacttaagtaactttagtttcaaaatgcttcaggtaccaaagaaaaccatggccaagtctaaccataatttaaccaaccagctcttgagcggcacgagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgctaaaaaaaananacaaatatggcggcgaaattggagctacttgccaatttgccctatgggagccgattacaattactggccgcggtttacaagtcgggactgggccctggcgttcccctttggcct

SEQ ID NO: 321305 - DNA, 277 bp, Homo sapiens
atttaagtctttcataagaattttatgaggacatagcaccaaaaagcaactcaaagagagctaactctcaagggtaaacaacctggacaaatgtctatagttttttgctgatctgaatttatttcaaaataaattctagtctatctagaagacttttccccaaagaatgcatcagaggttaaaatactaatagtagatattctgggaaaaaataaaaaggaagaggaagtatagcaggaagggtatggatgaaaaaaaaggagaaagaatgcagaat

SEQ ID NO: 321306 - DNA, 438 bp, Homo sapiens
gactataggatggaaaagtgacatcagaggagttacattacttcgttcagaaccatttcacaagtgcaagggattagccaagcctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321307 - DNA, 3557 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321308 - DNA, 3617 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321309 - DNA, 2791 bp, Homo sapiens
gaatcgagctctgtacccagcagcatagatattaccgacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321310 - DNA, 3608 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccgatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321311 - DNA, 2174 bp, Homo sapiens
cggtacccctcaacgctttatacttcagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321312 - DNA, 3371 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccctatggctgctggtgtaaataaactgcatctccccattggtaaacagtaataaaattttaaaaaatgaaaaaaaaat

SEQ ID NO: 321313 - DNA, 2543 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatacagatagctgattaactgtattcccctttcccctatggctgctggtgtaaataaactgcatctccccattggtaaacagtaataaaattttaaaaaatgaaaaaaaaat

SEQ ID NO: 321314 - DNA, 2097 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcggtaatatctatgctgctgggtaccgagctgattgtatcatgtaa

SEQ ID NO: 321315 - DNA, 3671 bp, Homo sapiens
agcggagcggcggggctaggcccgacaggggagcggaagaggcccaggaggctgggtgaggcgctgagacggtttggcggtgagtcctgggccaggcgcagctgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatactaacaagctagaggccatcgctcaggagatttacgtagacctgatagaggattcttgtttgggattctgctttgaggtgcaccgggcagtcaagtgtggctacttctacctggagttcgcagagactggtagcgtgaaggattttggcattcagccagtggaagacaaaggagcgtgccgcctcccgctttgctcccttcccggagaacctgggaatgggcctgatcagcagctccagcgctcacctccggaattccagtagctgcaaaatgagagtctgaaagtggccaggacaataacatagactggtcctgtggcttcgaggagtaagctaagtagaaaaaagtagaaaaatcagacaaaagttttaattcccccttgaagatcctagcatttaaaaacccaaagtggataatttaggaatcctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccagcatataaaatttttggttcctcagcctttctgtctgcctgatgtcaagggcttcctggacagtttggacgttacagttcgtcaggccgtgatcagtggcctgcagtgggactgctcctttgatatctgaacctctgttatgggcttctctgagacaagtaaatgtcaggtgcaagatctggatactaacagtttcagtttgggaaatccaagaaaaagaattatcaagtttgatagggaagctctgtagccttgactccagcaagaagaaaaggtcaaaaccacgtgtttcccaaaagtccagactacaatgattcagctgacttgaggacaaggcctagcatttggctgagcagagccctcttccttgccctccaacctggtggcataggcttggcaaatggacaacttggttgtccagacaggttgaggattcggttatgatcccctggggaggtagcagggacctctgcaactatgcatgatttctcaaacttcaagattcatgtctggatgtattatgctgtggatataagtttagtagggcggtcatttcctactctgagttactggttacctagccagtccatgggtgtgacttggtccttaagtcaggtcactatctgcctcccaccctgggggcaggactgaagtatagaagagcatcatggctgtgcaggaggctgtggtttgaaaactgagcccagagggcactttcagctgccctcaataatgtgaatggattagtgctaggagccaaggagcaggactggattatctcatctgactgtgtgcagaatcctgttgaatgtccctgttttctttggttgggcagtcagagctctgctatggtgaacatccagactgtcaccactttctgtctgccgctcgaaagggatagtcctttccactcggtcccctttggatcttcttgacaacaggagcagtccttttattgttagaagtcagagaaagacctccagaatctcctgactttagggaatggtataggggaagatgggaagtaagagtcacatatcaaaactaccctccactttattccctgagcgagggtttatgaagtataaaggggtgggagccccgaggtgagcgggaacggtgctgctttatttgaaatgttttcttacctcattctgtgccccagtagggggtccagcctcatctgtctggcttggccctgtgttcctcctgtcccctgctccactgcctatctggtgccccaggtgctgcttgccactccagctgtcacattgaacagtttcaattcagctcttaatgctcctgcttccgaagcctgcccaatttcttttttcttggcctctgtttttttttttctttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtaatactttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtatgtgtgtgttatgggggaaggggggggttctttaaaatttctgtggtttgtggctttttcttccatacattagttcccaccatcgcatgcccagggaccactgcctggcattatcgcatgctgggatcatcgggggagggtagtgaagctcaccactgtcctttgttttggagatttttatttttgcataagtagtccatcctatacagatagctgattaactgtattcccctttcccctatggctgctggtgtaaataaactgcatctccccattggtaaacagtaataaaattttaaaaaatgaaaaaaaaat

SEQ ID NO: 321316 - DNA, 547 bp, Homo sapiens
ctaggccttaaagtaagacagtgcccaacacatggcagttgcttgacacatttttattaaacctgtgctttggtccttttcccccaattcttgaagcttcccttctttcctaggctccctcgacattgcatggatcaggaagtactgtaaaagagcatactcttacttttgatgtgttgacctgagagtcctccccatctgtcttgcctactgacagcacccctgcccacacccaaaataaaacaacatcatcaaaaataagagtctgtcttgggatacataaggcttgtatcaagagcaaggatatgctcagggtatgttgagaaattactgctaaaattgaataaggatgatctttttaaattttctgggagaaaacagtcaagttctccccactttaagtttttcctcttaaaattttcataaggccaggtgcagtgactcatgcctataatcccaacactttgggaggccgaggcagaaggatcacttgaagccaggagttcaagacaagcctggtcaacgtagcaagaccccatctctatta

SEQ ID NO: 321317 - DNA, 540 bp, Homo sapiens
ccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggtaagtagggaacggtcttagggctccttaggggagcccagggaaggggagcgtggcccccaggcgtgcggccctgcagccccctcccctcggagccccggaaagcagccgtgtccgcgcttcctgccaagggtgggacgcccgcccgagccgctccgagcctgactccgcgcaagggcccgcgggcggacctcttggccttgtctctcgtgggaaaagactgccccagcctccctttgttcaacccacgagggttctaaaggggaggtctttgcagtcctgcccgctcttgggttctcttgaagattcttcatcctttcctctggctcccttatgagggaaactataaaaagaccatactctgtctcctta

SEQ ID NO: 321318 - DNA, 409 bp, Homo sapiens
gcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttattgctcagggtatgttgagaaattactgctaaaattgaataaggatgatctttttaaattttctgggagaaaacagtcaagttctccccactttaagtttttcctcttaaaattttcataaggccaggtgcagtgactcatgcctataatcccaacactttgggaggccgaggcagaaggatcacttgaagccaggagttcaagacaagcctggtcaacgtagcaagaccccatctctatta

SEQ ID NO: 321319 - DNA, 4089 bp, Homo sapiens
ccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaagctcaat

SEQ ID NO: 321320 - DNA, 3871 bp, Homo sapiens
ccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaagctcaat

SEQ ID NO: 321321 - DNA, 3772 bp, Homo sapiens
agagggagggaacgatttaaggagcgaatactactggtaaactaatggaagaaatctgctgcaccactggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaagctcaat

SEQ ID NO: 321322 - DNA, 4238 bp, Homo sapiens
ccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccggtatgaagctttagtaatatggggtgttgggaagggttagtttgactggaaaggaatttgtaagtcagagtgagggagactagattttgttgtatttggaccggaccacttccctaaggtctgtcatcatgagttttgatttcttacagttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaagctcaat

SEQ ID NO: 321323 - DNA, 3334 bp, Homo sapiens
ctaggccttaaagtaagacagtgcccaacacatggcagttgcttgacacatttttattaaacctgtgctttggtccttttcccccaattcttgaagcttcccttctttcctaggctccctcgacattgcatggatcaggaagtactgtaaaagagcatactcttacttttgatgtgttgacctgagagtcctccccatctgtcttgcctactgacagcacccctgcccacacccaaaataaaacaacatcatcaaaaataagagtctgtcttgggatacataaggcttgtatcaagagcaaggataatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaagctcaat

SEQ ID NO: 321324 - DNA, 4051 bp, Homo sapiens
agagggagggaacgatttaaggagcgaatactactggtaaactaatggaagaaatctgctgcaccactggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggaggtgctattggatcccttgggcacctccttctgttcactgctgccaccgcctctcttgctctatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattaaaaaaaaaagctcaat

SEQ ID NO: 321325 - DNA, 3310 bp, Homo sapiens
ccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgatctttaagacttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagccactgcgcccgggcaagaccttttttt

SEQ ID NO: 321326 - DNA, 1151 bp, Homo sapiens
ccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacttttctttaccggcatcactctcctcgcacccaggggatcctgcgtggttctttccatcttgttggtcaaccccacgatcagtctcatctccacggcaggcctggatgaagaacattttgggttggttctgtaggcttgggcagttggggg

SEQ ID NO: 321327 - DNA, 1491 bp, Homo sapiens
  misc_feature (1393)..(1393): n is a, c, g, or t
ctgaatctaaatcagtcttaaaacacgcctccggagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgtggtttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaccatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaaaaagaaaagaaaaaaaaaaaacgacccccacaagggggaaggccccaagtgggccccgtgcctgttgtcctctctggcctccagagattgtctgcattggcctcagctttctcactggccaattctccttcttcatgggcaccangccactgctaaacattctttcccttcacttcttgttgtaagctttgctccccttgagccacaggtttgcacattcttaaacctcagcttccagggaaa

SEQ ID NO: 321328 - DNA, 1435 bp, Homo sapiens
  misc_feature (1337)..(1337): n is a, c, g, or t
ctgaatctaaatcagtcttaaaacacgcctccggagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaaggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgtggtttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaccatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaaaaagaaaagaaaaaaaaaaaacgacccccacaagggggaaggccccaagtgggccccgtgcctgttgtcctctctggcctccagagattgtctgcattggcctcagctttctcactggccaattctccttcttcatgggcaccangccactgctaaacattctttcccttcacttcttgttgtaagctttgctccccttgagccacaggtttgcacattcttaaacctcagcttccagggaaa

SEQ ID NO: 321329 - DNA, 293 bp, Homo sapiens
cacagacgctctcacatttgtatttttcctgcagaagactgtatattagatgagatatccaaatttgttcattgtctgctttcttttgatgaagagatcatgtgatagcttcaaaaacaggtgcagaaagtaagatcacagccctggaacaaaaggaacaagagctccaagcactcattcagcagctttccattgatttgcaaaaggtaagtagaatatgaggagaagacctggatttctaagattcataaaaactaattctttcagaaatttctgcctgagagtagctactg

SEQ ID NO: 321330 - DNA, 4331 bp, Homo sapiens
ccattcatttttttgtttaattaacttcctttcctgatgtttgtccatttctggtatgtgcgtcaccctcctcacccaagactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatgga

SEQ ID NO: 321331 - DNA, 4005 bp, Homo sapiens
tgttgggattacaggcgtgagccagcatgcctgatcttaagtgtatttttcttagcatagcccaatgaaactttgtatttttgtgtcagcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatgga

SEQ ID NO: 321332 - DNA, 2031 bp, Homo sapiens
gcggccgctccaactcagacctcgtgccgaattcggcacgaggtgttaccattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatgga

SEQ ID NO: 321333 - DNA, 1806 bp, Homo sapiens
gcactgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgtaagtgcttattggagctgctgcattccaggcccttaatgctttctctccaggcctttgcagatgctccaaactcattccgaacttcggcaacggtacctggacctgcccatagatacagttcttgtgctggatgtgagcaggccagcagcagggggtggagggagtcaggacctaatggtgggcctgagttacctgggaggtgcaccagcagctcctttccaccttacatcccaccttctggtccagcctggtcctggggctgtcagaggtggcagctccgctaggagtcaagcctcaacttgcaatca

SEQ ID NO: 321334 - DNA, 367 bp, Homo sapiens
gaatggtcagaaaagatggatcagcttgaaaaggttagttcatctttatttttgtctcatttttgttggtctcgtctctggggtatggaaaacgttttatccggtaaccaacatactgattgctataccacctcttggaagcaggacagtttatgattagatactgacttgaaaagctctgatcctccccttttttggtgaatgtgcaggatgtcttttgtttgcccctcttgatatactctgcactcctcctctcttccctttctctgtgtacctgaacgccgatagaaactgtatcagcagggctcagaatgccctctggcatccggttgggttcagccagtggggaaccctgaaagaaccatgt

SEQ ID NO: 321335 - DNA, 4811 bp, Homo sapiens
gcactgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatgga

SEQ ID NO: 321336 - DNA, 4874 bp, Homo sapiens
gcactgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatggattttactagtttggtgtgtcagtatttctttgactcattaaatctggtattttgtgtctcata

SEQ ID NO: 321337 - DNA, 2054 bp, Homo sapiens
cacaccacctgagtccatccctggggcctacaggagaaccctgtacctcagcagccctgaaacctgctttccacttccggacctttctgaaatcaagacgcatctttagatcaatggcatcttactgtgtcaccggcgatactttgacagtaacaaggacgcttactctaagcgctttatctctgtggcctgcatctcccacgtggctgccatcgggtacaccacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacatgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacactggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaactacaatgga

SEQ ID NO: 321338 - DNA, 1074 bp, Homo sapiens
gcactgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatggtatgcatttttgttttagtagctaaatactgaatagatgattattcactctgattttactagtcatcactctctaattgctgataaacatacaccagtaatatgtgatattaatcatatttgatattaatcatatttgtatgtttttaaatttattaaaatagaaaagttctgtttaa

SEQ ID NO: 321339 - DNA, 715 bp, Homo sapiens
ttcacatttatttccttaaaacatttcactttcacaatctcttccctagtgtcttcagagtctgccaatggacaattttccagcactcaaagataaagacaatcttgaaattaagcttatacatccaggtcaggagttttgttctcacatgatttcagaagggtgaattcttaaattatcgattctaactcttcatcattgaattaatgggcttaatctaaaatgtagctccaaactaggaaatattttaattcaggctggattcaaaattccctggtcacaaagatgattcagtgcattaggatctgttgcatttatgccccaatttgcaatggataatattattttaatgctttttttatgcacacagatttttttaaaatagcctgaacaaatagaatttacagaaggacctccttgcaaaattctcatttggcacttattatagactggcttgtttcattagttatcttatttccatactcaattgtaaacaactgaagacaggatttacttacaagtcttcttatggcctgcagagctaggaactgaactgtgccttgctgcaggaacataaatatttaatgacagattggctgataataggacactaacaggacaccttcaaaaggagataccatataaaatgaaaggattgtctcctttataatagatgagaacagataaggttttctctctctctctttctctcatg

SEQ ID NO: 321340 - DNA, 454 bp, Homo sapiens
ataatttgggttatttccaataacagaattttttctgctgaaatatattttaaagaaaacacttttaaagagtccaatgtagatttttccacagtgtattctacagagcatattaagatgttaattaccgctctttgattacaggattccagggtcaaataattttgtttgataaacagtataaaacatattaatttactgcagaactttcagggcttccagtatgtgaatgtgtatactgaaatgttaagagggcatatagaatatgcagcattttccagaattatttgagaatggatattttttttcccttagagaacatctattaacaagcacccttggactctcatcctcaaagtgaggtcccagcactatgagcatcaccatcaatctggaccccaccccaaacctattgaattagatctgatggtagggcctagatgtctgtgtttta

SEQ ID NO: 321341 - DNA, 1165 bp, Homo sapiens
taagtgaaagcaagcttattaagaaagtaaaagaataaaaaggtggcttctccataggcagaaaactagcgtagttttttaattagaaattgttattcaataatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatatacatagagagatagtatgtagtatggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttaaat

SEQ ID NO: 321342 - DNA, 412 bp, Homo sapiens
tttttaagagatgggtgtctccctgtgttgcctaggctggtcttgaacagcctgggaaacagcaagaatcactttctaaaaaattaaaaataaaaagattagccggatgtggcagcacacacctaaagtctcagctactcatgatgctgagggaggtggatcacttgagcccaggcgtttaaggttacagtgagctatgatcatgccactgcattcttgcctcttttagtgagaccctcctttaaaaaataaaaagttatgtttacactcttctgtagtcttttattaattaattaacttttttattttttgagagggggtcttgctgtgtcacccaggctgaagtgcagtggcgtgatcttggctcactgcaacctccaccttctgggttcaagtgattctcctgcctcag

SEQ ID NO: 321343 - DNA, 2504 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321344 - DNA, 2579 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatccaaaaaaaaaaaaaaaaaaaaaaaaaaaaactgtttggggcgcgcttgggcccttcgaaaaggctttctctagaaaccccatggcggtggggcgcgcgcggggggcccccagagtggtgtctaggtggcacacgtgtggccacaacgagcgcgtggtcccaagaggagaaaacccgcggacacaagagaaaatagggggcgtagggagtcttctctccccttatatataagaaacgcgccggggggggacaaaccccagaggacggctgtcttgagacaaaatctcctagaaagtgggcatctcccgagaggggccaatatcaacgggggcctctctaccacacgaggggggctcccaaaggacgcgcccagataattaaatttacccgct

SEQ ID NO: 321345 - DNA, 1820 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttacccta

SEQ ID NO: 321346 - DNA, 2055 bp, Homo sapiens
  misc_feature (17)..(17): n is a, c, g, or t
gggtcgccgctgcgaanggagccgcgccatgtctgcgcatctgcaatggatggtcgtgcggaactgctccagtttcctgatcaagaggaataagcagacctacagcactgaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321347 - DNA, 2449 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattgttccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321348 - DNA, 2437 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaattgtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321349 - DNA, 1525 bp, Homo sapiens
ctctctctctctctctctctctctctctctctctctctctctcctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321350 - DNA, 1490 bp, Homo sapiens
caccaggatgatgagtttagtcctggaatagatgtcgtacaagtcgggtggtgaactgcactgaacatgcctggagtgatgttaggaagacagcaagctgaaaattagcattccagaagggataaagccatctgcatacaatattagaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321351 - DNA, 905 bp, Homo sapiens
  misc_feature (7)..(7): n is a, c, g, or t
ccctttnaggggaagaaaaaaggggggggcccccccccccaaaaaaaaagaaaaattttcggggcccgaaggatttaaggttcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321352 - DNA, 1057 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccagtaagtaatcaacccttctttgtatcagaacaaacaatccattcatttctagcaaaatattccagaggaacataaggacagaggacagaattgttggttgaaggccttaaccccatatggggagttttttcttcttgcgaggagcagctggagatgaccaaagtctcctgagagagtgagtgacaggctctccatgacgttctccttagggcatgtgtgctggcttgttgattggttacatctgtgattgtcagaattttctttcctttttactatataccccttcggtaaaaaatgtttgagtgtgtctccctagtatattttttatttataaattatattcttgtactactgggtaaatatattttttaaatgcacaaaaagaa

SEQ ID NO: 321353 - DNA, 1104 bp, Homo sapiens
  misc_feature (1041)..(1041): n is a, c, g, or t
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaattgagagggtgcccaattcttattgtcgggactcaaaggtatattanaggatcccattcatatgctcgatgtactggggaggcttacttgtataagctgagtgcggactt

SEQ ID NO: 321354 - DNA, 2221 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagaaaaaaaactggggagcggcaggtttcccttgcggttgtgatctttattcccatcct

SEQ ID NO: 321355 - DNA, 2450 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactgaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321356 - DNA, 2423 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321357 - DNA, 2454 bp, Homo sapiens
gcttccagcagggctagaagatgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321358 - DNA, 1349 bp, Homo sapiens
ctaactttgtcttctccatcatctaggttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321359 - DNA, 1182 bp, Homo sapiens
acttagaggatcccgttatcgccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattgattca

SEQ ID NO: 321360 - DNA, 1147 bp, Homo sapiens
gccatttctacagaaagttaaaatttagctgggcatgctggcacatccctatagtcccagctacttgagaggctgagttgggaggatcccttgaggtcatgagttggagtctacagtgagctgtgattacagtgtgagtctacactgcactccagtctgggtgaaagagatcctgtctctcaaaaaacaagtgattctcctgggaagagatttgtttaaaaagtctgcacctctattgatgataactttgaatgtaaatggattaaattctcccacttaaaagatatagattgactgaatggattaaaaaccaccatcatgactcgactgtatgctgcctacaagaaacctcacctgtaaagacaggccaaaagtgaaggtatggagaaagatattgcatacaaatggaagccaaaaaagagcagaaataactatacttacatgagataaaatagactttaagtcaaaaactgtaaaaagaaaagtcattatgtaatgaaacaaggatcaattcatgcaagatataatcatatttttttattaagaaaatttttttgtagagatggggttatgctatgttgcctggctagtctcaaactctgggtctcaaagcagtcctcctgctttggcctcctaaggtgctgggattataggcatgagccactgtgccaggcctgaggatattatcattataaatatatatgtaccccacactggatgacccagatataaagcaaatattattagatttaaagggagaaatagactctaatacaatagtagttgaggacttcactctactctcagcattggacagattttctagacataaaaccaataaatattggatttaaattgcactttacaccaaatggacctgacatttacagaacattctaataggtgcagaacactctaatagctgcagaacacacgttcttttcatcagcacatggaacattcaccagactagttctggaacccacttcctgccttagtgttctttccaccacagtgcatgataattccgacagaacgccttttatttgtaccttattagttgtagggggaaagctttttcatgtacaaaaatgctgtaattttctgatttaataaagtaattccactgatgtttttatttacttct

SEQ ID NO: 321361 - DNA, 4107 bp, Homo sapiens
ccgaagggcgtccacagcgactcctgctatgcagggcagctgctgccagggccgggcccgggaccccacggaggcggggagaccactcttctcccacacgagcccagctctcccttcgagtagcaaccgccttcaagctcacaagcacccgtgggcctggggtgtgcctgcgtctagctggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321362 - DNA, 4292 bp, Homo sapiens
agttcccctgatcactgtagaatgttttgtggtgacaggtgcatcaccacgggcttaggtgcagggtacactccaggcctggcagtggagggctgtcctgaccctgttccccggcccagcccagggcacatgacccctcagttcctgtcccaccccgttccctggaagaagcttggtttccagtagggaatcaggtgcagagtgtgcagtatagattcagcgtttgtcgactgactgaatgatagcacaatccaggctgcttcctgttggctgggtttggttggactgggacccgtcagaggaaaaggcaacgccgctgacaaagaacattgccgaaaggttcatgggaggctccggcttaacaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321363 - DNA, 6857 bp, Homo sapiens
gattggcaggcgactccccgcccctgccccgcccccctgggcgaagagcgcggacttgtggggccgctggctgcagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgcggtggccgggccccaggggcgggagcaggatgtgagtagaatcctccaagccctacacgagtgccttgctgcccttccccgaccccagctccggagcgtcgtgggcatcggggtgtcgggccagatgcatggagtcgtgttttggaaaacaggccaaggctgtgaatggacagagggagggattaccccggtgttcgagccccgagctgttagccacctggtcacgtggcaggatggccgatgtagcagcgaattcctggcctctctgccccagccgaagtctcatctcagtgtggccacgggcttcggctgtgcaaccatcttctggcttttgaaatatcgcccagagttcctgaagtcctacgacgcagccggtaccatccacgactatgtggttgccatgctgtgtggcttgccaagacctctgatgtccgaccagaatgctgccagctggggctatttcaacacgcagagccaaagctggaacgtaaagacactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcagttctcaacatcagcacctcggttcagctggcagcctccatgccttcaggattccagcctgcacagactccagaccctacggccccagtcgcctacttcccatacttcaacaggacctacctgggggtggccgcgtcactcaacgggggcaatgtgctggccacgttcgtccacatgctggttcagtggatggcagatctaggcctggaggttgaagaatccactgtgtattcacgcatgattcaggcagctgtgcagcagagagatacccacctgaccatcaccccgacagtgctgggggagaggcacctgccggaccagctggcctcagtgaccagaatctcctcctccgacctctccctggggcacgtgacccgggctctgtgccgaggcattgttcagaacctgcactccatgcttccgattcagcagctccaggagtggggcgtggagagggtgatgggcagtgggagtgcgctgtccaggaatgacgtgctgaagcaggaggtgcagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatctcggccaagaacttaccttcagaacatactctaataatgcagccaggagccgtcagccagatcccaaatgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggtggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321364 - DNA, 4421 bp, Homo sapiens
ctgccgctcaccctattccagggacacagtctgcttggctcttctggactgagccatcctcatcaccgagatcctccctgaattcagcccacgacagccaccccggccgttttccttgttctgtgtggggagggaggcagcgcggtggttatcaacctcaccctgcagaggaggcacctgaggcccagagacgaggagggatgggtctaacccagaaccacagatggctctgagccgggggcctgtccaccctcccaggccgacgtcagtggccgcaggactgcctgggccctgctaggcctgctcacctctgaggcctctggggtgagaggttcagtcctggaaacacttcagttctagggggctgggggcagcagcaagttggagttttggggtaccctgcttcacagggcccttggcaaggagggcaggtggggtctaaggacaagcagtccttactttgggagtcaaccccggcgtggtggctgctgcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321365 - DNA, 3785 bp, Homo sapiens
gattggcaggcgactccccgcccctgccccgcccccctgggcgaagagcgcggacttgtggggccgctggctgcagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgcggtggccgggccccaggggcgggagcaggatgtgagtagaatcctccaagccctacacgagtgccttgctgcccttccccgaccccagctccggagcgtcgtgggcatcggggtgtcgggccagatgcatggagtcgtgttttggaaaacaggccaaggctgtgaatggacagagggagggattaccccggtgttcgagccccgagctgttagccacctggtcacgtggcaggatggccgatgtagcagcgaattcctggcctctctgccccagccgaagtctcatctcagtgtggccacgggcttcggctgtgcaaccatcttctggcttttgaaatatcgcccagagttcctgaagtcctacgacgcagccggtaccatccacgactatgtggttgccatgctgtgtggcttgccaagacctctgatgtccgaccagaatgctgccagctggggctatttcaacacgcagagccaaagctggaacgtaaagacactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcagttctcaacatcagcacctcggttcagctggcagcctccatgccttcaggattccagcctgcacagactccagaccctacggccccagtcgcctacttcccatacttcaacaggacctacctgggggtggccgcgtcactcaacgggggcaatgtgctggccacgttcgtccacatgctggttcagtggatggcagatctaggcctggaggttgaagaatccactgtgtattcacgcatgattcaggcagctgtgcagcagagagatacccacctgaccatcaccccgacagtgctgggggagaggcacctgccggaccagctggcctcagtgaccagaatctcctcctccgacctctccctggggcacgtgacccgggctctgtgccgaggcattgttcagaacctgcactccatgcttccgattcagcagctccaggagtggggcgtggagagggtgatgggcagtgggagtgcgctgtccaggaatgacgtgctgaagcaggaggtgcagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatctcggccaagaacttaccttcagaacatactctaataatgcagccaggagccgtcagccagatcccaaatgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggtggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcctgtaatcccagcactttgggaagcccaagtgggtgaatcacctgaggtcaggagttcaagaccagcctgaccaacatggggataccccgtctctactaaaaatacaagccgggcgtggtggcgcatgcctgtaatcccagctactcaggaggctgaggcaggaaaatcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaagctcttggatgagagcaatgcctgatcactctggccaaatgtcagatactaaagccattcttggcgggcatgtggctccgctgttatccaacacattgggaagccagtgggtgaatcaccgaggcggagtaaacccgcctgcaatgggattaccggtctataaataaacgggtggggctgcttaaccaaacaaggggaggaactagacggaggggggatagacccctcccggggaaacttttaatacgctctgtctgatacttacagagacatagggcatatcataccagcctgcgaaaa

SEQ ID NO: 321366 - DNA, 4585 bp, Homo sapiens
tctacaaaaaaaaaaagtttggaaattggccaggtatggtggtgtgtgcctgtggttcttagctgttcgggaggctgaggtggaaggatcgcttgagcccagaaatttgaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttcccaagttttcccttgtgcattgttctgagcagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321367 - DNA, 3838 bp, Homo sapiens
gattggcaggcgactccccgcccctgccccgcccccctgggcgaagagcgcggacttgtggggccgctggctgcagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgcggtggccgggccccaggggcgggagcaggatgtgagtagaatcctccaagccctacacgagtgccttgctgcccttccccgaccccagctccggagcgtcgtgggcatcggggtgtcgggccagatgcatggagtcgtgttttggaaaacaggccaaggctgtgaatggacagagggagggattaccccggtgttcgagccccgagctgttagccacctggtcacgtggcaggatggccgatgtagcagcgaattcctggcctctctgccccagccgaagtctcatctcagtgtggccacgggcttcggctgtgcaaccatcttctggcttttgaaatatcgcccagagttcctgaagtcctacgacgcagccggtaccatccacgactatgtggttgccatgctgtgtggcttgccaagacctctgatgtccgaccagaatgctgccagctggggctatttcaacacgcagagccaaagctggaacgtaaagacactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcagttctcaacatcagcacctcggttcagctggcagcctccatgccttcaggattccagcctgcacagactccagaccctacggccccagtcgcctacttcccatacttcaacaggacctacctgggggtggccgcgtcactcaacgggggcaatgtgctggccacgttcgtccacatgctggttcagtggatggcagatctaggcctggaggttgaagaatccactgtgtattcacgcatgattcaggcagctgtgcagcagagagatacccacctgaccatcaccccgacagtgctgggggagaggcacctgccggaccagctggcctcagtgaccagaatctcctcctccgacctctccctggggcacgtgacccgggctctgtgccgaggcattgttcagaacctgcactccatgcttccgattcagcagctccaggagtggggcgtggagagggtgatgggcagtgggagtgcgctgtccaggaatgacgtgctgaagcaggaggtgcagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatctcggccaagaacttaccttcagaacatactctaataatgcagccaggagccgtcagccagatcccaaatgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggtggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcctgtaatcccagcactttgggaagcccaagtgggtgaatcacctgaggtcaggagttcaagaccagcctgaccaacatggggataccccgtctctactaaaaatacaagccgggcgtggtggcgcatgcctgtaatcccagctactcaggaggctgaggcaggaaaatcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttcccaagttttcccttgtgcattgttctgagcagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggtcagtctttttttacttcattagggccccaaagcaccagagtagtgatgctggtagtgatgctggctgttcggatatgccaaagagaaaccgtaaggtgcttcctttaagtgaaaagatgggaagaaaacagtcatatgctgaatcttctatctgtgaaattct

SEQ ID NO: 321368 - DNA, 306 bp, Homo sapiens
ttgagattattcagctagcggacagtactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggctaatctggggtatttttttcctagataaggggagtgcgccatgtggccagccata

SEQ ID NO: 321369 - DNA, 4547 bp, Homo sapiens
ggatgcagccaggcagactcctgcacagacatgccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321370 - DNA, 5290 bp, Homo sapiens
ggatgcagccaggcagactcctgcacagacatgccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcctgtaatcccagcactttgggaagcccaagtgggtgaatcacctgaggtcaggagttcaagaccagcctgaccaacatggggataccccgtctctactaaaaatacaagccgggcgtggtggcgcatgcctgtaatcccagctactcaggaggctgaggcaggaaaatcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttcccaagttttcccttgtgcattgttctgagcagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321371 - DNA, 3325 bp, Homo sapiens
ttgagattattcagctagcggacagtactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtgtggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatataaatcg

SEQ ID NO: 321372 - DNA, 367 bp, Homo sapiens
tacatgctcatcctaactctactgcctaaaacagagattgcatgaagaaaaaggtaataaagtccagcttctgccctgccttagagacccagggctactaccaatgaggaactgggctatgttgtgagtcaagaaagttttcacttcatgacttacattctcttccttgcccagaaaacatctatacacagcatagctacccaaggactagaaatggtgcaatgccttctgagaacctagaagtggtcctatgggaaaagcactctgtgagagggggtaaagacagtcatgacccagaagtggtgcatgcaggaaactgtatttttcacatattgcatcagaccagaagaactgaagaaccagatgc

SEQ ID NO: 321373 - DNA, 1875 bp, Homo sapiens
tacacacaaaagattttaagaaacagaagagaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcttctctctgtttcatcagaaacacatactataatacttgtctctgtccttaagtgtgatacacgctatttttctgattgttaagactttccttattactggttctaatttgattataatatgccaaggtatggtc

SEQ ID NO: 321374 - DNA, 1847 bp, Homo sapiens
cagatttttttccttcttcattaactggttatagggaactccttttgtgtgagaagtgaaagagaatgcataggctgaggagatgaagaactttgaagagtgagctcatcaaatacaattcagacatgaacagagatcacaaagagtgtcaccaacctgcacaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcttctctctgtttcatcagaaacacatactataatacttgtctctgtccttaagtgtgatacacgctatttttctgattgttaagactttccttattactggttctaatttgattataatatgccaaggtatggtc

SEQ ID NO: 321375 - DNA, 1764 bp, Homo sapiens
tacacacaaaagattttaagaaacagaagagaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcttctctctgtttcatcagaaacacatactataatacttgtctctgtccttaagtgtgatacacgctatttttctgattgttaagactttccttattactggttctaatttgattataatatgccaaggtatggtc

SEQ ID NO: 321376 - DNA, 763 bp, Homo sapiens
  misc_feature (762)..(762): n is a, c, g, or t
ttttgagccttaaactgctgtcttgtttccctggctgagaaccctggaaacgagggtcctgtgcttagccattccccatccactcaggagagcctgcttcttaatacctgccccacaggtggggtcctgcttgccccagcagacggtctgcctgtcaccttcgatgtctgcaccattgcattcctggatgacccatttcgtggttcggtcatcatgtccaggctattctattttctgacttcatactacgttttgcctgcactaccacttgtatttttgctaccctaccttttgtgcttctggctaaaatagctaactagctagacaggagttgtctggagaagtacaaatgagtctttaaaacccatcctcagtgccccatcagtaagtacacattgtgaatttttacatctataaggttactctattttaaagtaattttaaaattttaaagtagttttgtctgtatttgcttctttgccttatgtattggcttagtacctaattctttttttgtttatttgtttgtttttgagacggagttccagcctgggcaacagagcaaaactatgtctcaaaaataaataaataaataaataaataaataaataacctagtgtctggtattctgttatagaagcacaaaacatacagtgactgtggttatccaatttcacactcccaaagtaaagtgctgggattgccggtgtgagccaccgaatctgtcctgttcgcataagttctgctacatcatgttatttnt

SEQ ID NO: 321377 - DNA, 495 bp, Homo sapiens
cttagagacagtaggaaaatggtatctcccggaagttacctcacgacctccaagagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 321378 - DNA, 447 bp, Homo sapiens
  misc_feature (15)..(16): n is a, c, g, or t
aaggatctttaattnnattaatcccccccccccggaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 321379 - DNA, 366 bp, Homo sapiens
taaattcgcggccgcgtcgacgtcagattcccaaactcgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 321380 - DNA, 512 bp, Homo sapiens
  misc_feature (438)..(438): n is a, c, g, or t
aaaaataagtaggaagtgctcaattttaatttggttcagttttccggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcacccccanaatcatatttctccttctcccactccagcgccctcttacctttcttttctcgtctcatattagccttccctctc

SEQ ID NO: 321381 - DNA, 1652 bp, Homo sapiens
cttagagacagtaggaaaatggtatctcccggaagttacctcacgacctccaagagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctggagtgcagtggtgtgatctcggctcactgccatctgtgcctcctgggttcaaacgattctcctgtctcagcctccgagtagctgggattacaggtgcaggacaccacacctggctaattttttgtatttttagtagagacaggtttcaccatgttggccaggctggtctggaactcctgacctcagatgatctgtgcgcctcagcctcccaaagtgctgggattacaggcgtaagccatggtgctctgggcctcaaatactcttcttagctacacaaatgaactgttaaacctcacaagcacctttaacgtatcctcatttggcagatgaggaaatgggcacagagagattaagtaatttgccagaaattatacagcagtgaatggtggagtcttgcactaaagtgatgctcttaaaactatgctctattgcaggggtgtccaatcttttagcttccctgggccacacataaaatacgctaacattacaatagctgataagctttaaaaaatggcaaaaaaaaccctcagcgttttagaaagtttacaaatttttgttgggtcggattcaaagccatcctgggctgcttgctgcccaggactgcggttggacaagcttgctctactgcctttcctcctaaggcaggccttagcctgaggggatatcagctataaaacggatgaggtgatctcttagcctccacagcagttttctgtttctgtgccagaggccaacaatgttttcgaccatatgtggttcataaagcctcaaagatttactctggccctttatgaataaagtttacccctgatct

SEQ ID NO: 321382 - DNA, 899 bp, Homo sapiens
  misc_feature (15)..(16): n is a, c, g, or t
aaggatctttaattnnattaatcccccccccccggaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggagcgggaggctggaccccagcagcagcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 321383 - DNA, 1204 bp, Homo sapiens
  misc_feature (15)..(16): n is a, c, g, or t
  misc_feature (955)..(955): n is a, c, g, or t
aaggatctttaattnnattaatcccccccccccggaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggagcgggaggctggaccccagcagcagcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaaaaaaaaaaaaaaaaaaaaaaaaaaaaaaaaaacaaaaaaaaaaaaaaggcccagngaattttaaattcgagcaagtttatgcttgcggccgaaattggagctaatttggccaatggccttttaggggggggtataaaataacgggccgggtttacacccgggggattggaaaccttgggttaccaattaatggttggagaaattccctttcccagtgggtaatacaaaaggcggcccgacgccttccacattgccccctaatgggaaggaatttgcgggtattttgtaaaacccgtaattttgt

SEQ ID NO: 321384 - DNA, 846 bp, Homo sapiens
  misc_feature (15)..(16): n is a, c, g, or t
aaggatctttaattnnattaatcccccccccccggaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggagcgggaggctggaccccagcagcagcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgctttctctggaagaggagtctgcattgtagtgtctcaaagacacaataaacttcctatggtctgca

SEQ ID NO: 321385 - DNA, 280 bp, Homo sapiens
  misc_feature (15)..(16): n is a, c, g, or t
aaggatctttaattnnattaatcccccccccccggaacgagtcaaccggatcggtgactgtggagggcgagctgagccctagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 321386 - DNA, 347 bp, Homo sapiens
ccggatcggtgactgtggagggcgagctgagccctgtgcgtgagtggggtctggttgtgcagtgttcgtggaccctgggaggctaggggcgccccgctgggctgggaaaggataaggagtgcaggggcaggagtctggggttggggatggacccccgcggggactgcggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgc

SEQ ID NO: 321387 - DNA, 1146 bp, Homo sapiens
cttagagacagtaggaaaatggtatctcccggaagttacctcacgacctccaagagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaaaaaaaaaaaaaaaaaaaaaaaaaaaaaaaaaacaaaaaaaaaaccccgggggttttttttggggggggggaaaaaggtagttgtaaagggggacgacgtgggttactaaaggtgtgttctatccgacaccccacttttttttgttgcaacgggtgggaaaatctagggggggccccccaataatggaggagggcagtataatatattaaaaaacagcccgggtacccgcggtttatatatagtcgtgtagtaacgcacagaaattacacgcacaacaaagagggcggagaagatgtgggagagcaaacaacgagattaataagtgcagaaacacacgattaaaaacagagagagaagaaaatcatcatgtcagtcagacagaaaaaaaaaaacaaccaactgaaaccacacaaagagaaggagtgttattgaagccgaagagagaaaaaaagaagcaccaccattatatttacccagaggaagtaaatcgtggcatcatagaagcgaagcaacaccaaaaaatgtgattatatataatagagcgcaagtatgaccgcccccaaaaaacacatatatggacacgcgaagacaccacgctggagaacctaaaccgaagtgtataccgcagaaggaaaaatttaacacggcag

SEQ ID NO: 321388 - DNA, 826 bp, Homo sapiens
  misc_feature (577)..(577): n is a, c, g, or t
cttagagacagtaggaaaatggtatctcccggaagttacctcacgacctccaagagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaaaaaaaaaaaaaaaaaaaaaaaaaaaaaaaaaaaaaaaaaaaaaaaaaaaaaaaaaaaacaaaaaaaaaaaaaaggcccagngaattttaaattcgagcaagtttatgcttgcggccgaaattggagctaatttggccaatggccttttaggggggggtataaaataacgggccgggtttacacccgggggattggaaaccttgggttaccaattaatggttggagaaattccctttcccagtgggtaatacaaaaggcggcccgacgccttccacattgccccctaatgggaaggaatttgcgggtattttgtaaaacccgtaattttgt

SEQ ID NO: 321389 - DNA, 431 bp, Homo sapiens
aaaaataagtaggaagtgctcaattttaatttggttcagttttccggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 321390 - DNA, 675 bp, Homo sapiens
  misc_feature (15)..(16): n is a, c, g, or t
aaggatctttaattnnattaatcccccccccccggaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcaaaaaaaaaaaaaaatattaaattaatattttaaggaattatataattattatgtaaaaaatatttatccatggcggccggaatttcgggcttacttggcccaattcgccctaatggggagtcgttttacaattaaatggccggcgttttaacaacgtacggaacttgggaaacacctggcggttaccacaattaaatcggctttggaagacatatccccttttggcca

SEQ ID NO: 321391 - DNA, 1364 bp, Homo sapiens
tggtgaacagtagcaaaatctggagtaactgtgcctggaattttttggccccaagtctaaacaaaggaatagtttccagataagcgctgtttgcataggtggtggtctgtcacgtggtgggccaggctattcagttcttggtcagcgagacgcctgccttgggtgctggatgccggctgtacgacatgcggctctcccctttccatttacagctggagttccacatgaaggagaagagagaggacctccagattagctggtctttcatcagtgtgccggaaatggccgttaatatccagcccaaagcactgggggaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttgtgagtctggccgggttatgggcctgtgtgtccacggccgtgtctgttcaggagcgccaaatcctgaaatcattctgcagcaccgtttaggctaaaacactaaaccaaaacagttaacaacaaatgatgtcttaagcatcttaaaggtagctttaggtcaaacatgggttttgttgtaaaggcagctcttagagtcagttttctcctcctgccctgatatgatgagagggagccatcgtggggtctcttacagacacacatatcatccagggtgaaaagggagggagcctctgactgaatccagaacctaacgaagaaaatagaaaaaggcgctgggtgcagaggctcatgcctgtaatcccagctgtttgggtggcagagacgggagaatcgcttgagcccaggagtttaagaccagcctgagcaacatagcgagacctcttctctactaaaagttttaaaaaatttaaccgggcatggtggcccttgccttgcctgtagtactcctagctatttgggaggctgacgcaggaggattgcttgagtctgggagagcgaggcttcagtgagctgtgattgtgccactgtattccagcctgggtgacagagagataccctgtctcaaaaaaaaaagctgaggtgggtagaggtcaggagttcgagaccaacctggccaacatggtaaatgaaa

SEQ ID NO: 321392 - DNA, 1739 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321393 - DNA, 1768 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctgataaaagtggagctgctctgggtgaaacctggagtgttgactgcttagcctccacttcggccttcctagaaacccagatgttactcctcggaacctttagtcctcattggagcacagttgggaactcactggacagggaaaatgggaccatggaatggagaactttgaactgaagagtgagggggattttcctagttcactaggccattgggaaacactaaaactttctaagaagaaggtcatttctagtctctcccattctttaccttagtcacttctctgaaagaccaacccatgaccagctgcaaacagagaacatgaaaggaagtccatgcgtaatgaatcagtttcttcagtgacaaatctggggtcccggttgcatgggcaaatagtgaagccagaatagaggtggtagaccaagaaagaaatgtcagtggactgactggcagctgccctaagaacagtacatgtgttgagtggaacaaagggaataagagaggtggaagcaaagtcagtcattgtgaaaggggaataatttcagaattaaagacagtaagttttgagtaactcaactgaaaattaaatttgttgtacgtctaagctgaaggatttttttgaggaagctgaaaaaatatcaggtcagtgggttgaaaagtcatttctatgtatattaaagtctccaaatttggaagctaaggatgtagtggaggaggttaatagtgctcatgtttgaggaaggtacgagagcaaaactcttagtttccagcgggcagaagaataccttggttggcatttctctttgcctcccagcttttactcttttgaatcttatctttgaagcactctttctccacctctttttgcctgaatttggacatactgtcttactctcttagtttatggagaccagcaagattcaaaaactcaaaaaactcattaaatatatacacacactcagcaagacataaaaagagatttcacaaaaaaatgtgaaagtatcaaaagatttgttactcaacataactaaaatattaagcaacatgttttgattggaatagcatatctgcagtctgttctgttttacctaataaatcttgtctattgtctgtcttt

SEQ ID NO: 321394 - DNA, 1820 bp, Homo sapiens
  misc_feature (1772)..(1772): n is a, c, g, or t
  misc_feature (1820)..(1820): n is a, c, g, or t
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaagaaaaaaaaaaatggctcgttggccttaacggggngaccctcggcccttccttagggagggtatttatgacctcctcactgcn

SEQ ID NO: 321395 - DNA, 1684 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagttttatcaatatgaaggcaaccttggctgataaaacctctatagtgaatactcacatctttacttcactcactatcaataataaatatattttctgacaaaga

SEQ ID NO: 321396 - DNA, 1687 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctattttatctccttctgctctttatcgattctagttttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321397 - DNA, 1363 bp, Homo sapiens
ctaaattggcatggtattggattgctgactagaaatacttctatctcaaccttataaccaactggctgttttaccttggtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321398 - DNA, 1305 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321399 - DNA, 790 bp, Homo sapiens
ggctgatgtggagacacggtatcctctgtttgaagggccagagactggtaaaaagagaccatcgaggaatgaggaccattttgaccacttttgaccacttgcgctaattaaaaaaaaaaaactacgcttgagctaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321400 - DNA, 300 bp, Homo sapiens
gcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccgggtgagtgcccgtggacgggcggagggccagtggttggactcggaccccaaggccccatcttctccggacccgctcagcctgggtttctcccgtcctggaccctagcgtattaaggccagaagcccaggtgtctgg

SEQ ID NO: 321401 - DNA, 1705 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagtaagtttttaatagtattataattatttactattcttaacaagatgaaagcacagttttagtgctttttgcacagatcatagtttgttatatagcactctagaatacttggaagagttttggggtggttgagatgggggccatgttatctgctatactggaattcagatgccaagacaaaggcatttgatgaaagcttgttacaaatccatgtattttatgaactagggggaaattgaaagcaatggtaatagtattatcatttgtaataatatataaaatagaatgctcttgattatgaaggtcatgttaaattgctactgtattaagggaaacatagaaaccattcacttttgtataataaaatgatgggcatgtccaaatttgggtatctgcctttctcgtggttaggctgttttcatttcttcacatgtaccttgaaaggctttaaatcatagactttacctggcccttgattatgaaggtgatgttaaattgctacctctcttaatccttggagtgtttaaatgaatgttctgtaattgatggatcaaagtgtccgtgtcccatagctttgtactttccctttgctgccagttctcacattaggttagaagacatcattcagaatttttctgagtatataaatagtcctattgtgtaacctctattagtagcacatgcgcaaattagtgaagcaaaaaaagttgttgtgacagctttagttgaaagattgcatcgggctctgacctccttccttgcacatgtttacaagcatttgataaaatgattaaaccctaaggtggaattactactttctgctacagtacaatttgtgtgttaatggatattagtgttattgtaatgtggattaaaataaaattttttaaaaatt

SEQ ID NO: 321402 - DNA, 1781 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactgctatctgtccttaacgcacgcgcgctaatcgatacgtggggtggggagagagacagcagccggcgcccgccgggctcaccgggggcggccgc

SEQ ID NO: 321403 - DNA, 1751 bp, Homo sapiens
  misc_feature (340)..(340): n is a, c, g, or t
  misc_feature (349)..(349): n is a, c, g, or t
  misc_feature (361)..(361): n is a, c, g, or t
  misc_feature (365)..(365): n is a, c, g, or t
  misc_feature (372)..(372): n is a, c, g, or t
  misc_feature (394)..(394): n is a, c, g, or t
  misc_feature (403)..(403): n is a, c, g, or t
  misc_feature (408)..(408): n is a, c, g, or t
  misc_feature (417)..(417): n is a, c, g, or t
  misc_feature (427)..(427): n is a, c, g, or t
  misc_feature (435)..(435): n is a, c, g, or t
  misc_feature (459)..(459): n is a, c, g, or t
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaaaaanaaaaaaaangaggagaagggnaaanggcaaanggaaaaagagaaaaaacgaaanaaggaaaanacaanaacaggaangaagaaaaanaggaaaanaggagcaaaaggagcaaaagaaanagaagaagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321404 - DNA, 1685 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattggatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321405 - DNA, 1176 bp, Homo sapiens
attgtccagactaactcacagtagtgtcaattagtggaactaatttcttagaatttatttaccctttgtcatttttatcatgggaaaaatttagctatctttgaagtttaaggaaaattctttctcttaaacctttttctacatttgcaacatctgtgtcttactgtgcgttttatgtgttctttaaccttgatttttattctgaatgaagaccattggtctcagcggtccctgtgtttgttttcaggcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 321406 - DNA, 728 bp, Homo sapiens
ccacctgttgccatagcatccgggtcgggtgaaccaatccgggcgccctcgccgaacagaggcgggcagttcgcatcgccgaccaacctgaggcgtttttgttgtggcgcgtgaccggaggaggcgggagctcaggaccggcgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgacggactaaagcaagcccaaaagagctggaacccgaggagaggggcttgggtggccaaatggagccaggttaaacccaggaaggccatccctttcggggaggagggattatggtaggcggagggagggaaacggcggctaaaggggccaaaggcaccatgtggattattggaaggacaaaagcctagaggc

SEQ ID NO: 321407 - DNA, 2410 bp, Homo sapiens
  misc_feature (1782)..(1782): n is a, c, g, or t
gggaggaagcgctgcagggaccaccgccgtccccaccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaactcttaaacttttcttccaaaaaaaaaaaaaaaaaaaaaaaaaaaaaaaaaaaaaaaaaaanaaaaaaaaaaaaaaaaaaaaaaaaaaaaaaaaaaaaaaagagaagaggaggcggcgcagcggaaaaaatctttcccctgcggggggccgcactattatcgcagcaccaccccgttagtttagatagaaagagggggccccacaaggaggagcgggtaatatattatatcacacagcgccgcagcggcgccggcgtgatgttatacaacaataactgctgtcgtgtgacaggtagagcacaactatgcgccgatctcaggtggactccctttttgttcaatagaaccacaaccctacttctttatgggcgggggaggtgcaaatcacgaatcgttgggagaacaaaacaaccccctactaacacacaaggagagatattaattaaagccgcctcccacctctggagagctggagacatcaaacaataacaaatcctatctagcataataggatgagtcataatctatgaggtgaatgacagacacacaaacccaaccccttgaatactattatacgcgattgcgagctagcgtgaactagcagaatatgaatatacttcgcccacgacacccgcggtgcgttatctgtatatcctaggaccaccaaccactttatcatctacaccgggg

SEQ ID NO: 321408 - DNA, 1780 bp, Homo sapiens
gggaggaagcgctgcagggaccaccgccgtccccaccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaactcttaaacttttcttccaaaaaaaaacatacaccaaacataagcaaagaaacaaaaagg

SEQ ID NO: 321409 - DNA, 1558 bp, Homo sapiens
gggaggaagcgctgcagggaccaccgccgtccccaccgccatccgccctcccggcctggcctgcccttgcgcccggctccccagtgcccgccgcccgcccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaa

SEQ ID NO: 321410 - DNA, 1720 bp, Homo sapiens
gggaggaagcgctgcagggaccaccgccgtccccaccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaa

SEQ ID NO: 321411 - DNA, 2390 bp, Homo sapiens
  misc_feature (1762)..(1762): n is a, c, g, or t
gggaggaagcgctgcagggaccaccgccgtccccaccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaaaaaaaaaaaaaaaaaaaaaaaaaaaaaaaaaaaaaaaaaaanaaaaaaaaaaaaaaaaaaaaaaaaaaaaaaaaaaaaaaagagaagaggaggcggcgcagcggaaaaaatctttcccctgcggggggccgcactattatcgcagcaccaccccgttagtttagatagaaagagggggccccacaaggaggagcgggtaatatattatatcacacagcgccgcagcggcgccggcgtgatgttatacaacaataactgctgtcgtgtgacaggtagagcacaactatgcgccgatctcaggtggactccctttttgttcaatagaaccacaaccctacttctttatgggcgggggaggtgcaaatcacgaatcgttgggagaacaaaacaaccccctactaacacacaaggagagatattaattaaagccgcctcccacctctggagagctggagacatcaaacaataacaaatcctatctagcataataggatgagtcataatctatgaggtgaatgacagacacacaaacccaaccccttgaatactattatacgcgattgcgagctagcgtgaactagcagaatatgaatatacttcgcccacgacacccgcggtgcgttatctgtatatcctaggaccaccaaccactttatcatctacaccgggg

SEQ ID NO: 321412 - DNA, 1459 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctcatcaacaaccgataatcaccaccaacaatgactaatcaaactaactcaaaacaatgataaccatacacaacactaaaggacgaacctgatctcttatactagtatcctttaaatcattttattggcacaaataacctcctcggatcctgcctcactcatttacaccaaacaacccaatatctataaaacctagcatggcatccccttttgagcgggcagtgatttacggttcgtctaagattaaaaatgcctagcccctttctacccaggaactaaccctatccccattatttttcgaactccgcacttaccaatacggcggcgtaccgaatgggccattcgccatgggcccaataaacccgcagacatcttcgcaaggcacgctgccgcaaa

SEQ ID NO: 321413 - DNA, 242 bp, Homo sapiens
gcggccgcctactactactactgctcgaattcaagcttctaacgatgtacggggacatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 321414 - DNA, 3997 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 321415 - DNA, 4020 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaataaaaaaaaaaaaaaaaaaaaaaaacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 321416 - DNA, 4424 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaagaaaaaaagagaacaaaaaaaaaaaaaaaaacattagacggggggggcgggagcaagaaaaaattcaacgcggggggagtgaagaagggacgagggatgacgaacatatattgaagagaggagagagggccagtagcgagagagagcacagagaaggggtaggggcggcagagtacagtataaaaagccaggagagtgggggggaaagagaggaatagaaagctactgggagagaggaagaacaaggatgtaggggcgagaagagctggagagaaaaaaaaaagaagag

SEQ ID NO: 321417 - DNA, 3943 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttagaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 321418 - DNA, 4118 bp, Homo sapiens
  misc_feature (4027)..(4027): n is a, c, g, or t
  misc_feature (4044)..(4044): n is a, c, g, or t
  misc_feature (4092)..(4092): n is a, c, g, or t
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgaaaaaaaaaacactggccgcgtttacaacngcgtgactgggaaaccntggggtcccactttcgcttgagacatcccctttcgcagctggcgtacnggccgaccgacgccttccacagtgcc

SEQ ID NO: 321419 - DNA, 4049 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgaaaaaaaaaagtcgacgcggccgcgaatttagtagtagtagtagtagtagta

SEQ ID NO: 321420 - DNA, 4206 bp, Homo sapiens
  misc_feature (4018)..(4018): n is a, c, g, or t
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgaaaaaaaaaaaaaaaaaaganagcgtccgaattcggcacgaggcgcgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggcggccgc

SEQ ID NO: 321421 - DNA, 4173 bp, Homo sapiens
  misc_feature (4069)..(4069): n is a, c, g, or t
  misc_feature (4128)..(4128): n is a, c, g, or t
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacattcttccaaattggagaatgtgcagctagctttgttttaatctgcttggcaaccagtgtagctgctgtaacaatctatcttattgttcaaatatataagagccaaactctnttccattccatctaaaatgttttcatttagtactcttctttcctcctactctagaactncaaaacaaaacaaaactttgagagcagcacattcttctatggtcc

SEQ ID NO: 321422 - DNA, 3937 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtctgcttgtgattgtgaatgactttgttctttgcttgtgtttttcaatttcctataatgcacatactaacttttaaaaaataaaggttattttaaaagcctg

SEQ ID NO: 321423 - DNA, 3943 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 321424 - DNA, 4294 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaataccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgaaaaaaaaaaaaaaaaaaaaaaaaaaaaaaaaaaaaaaaacaaaaaaaaaaaaaaaaaaaaaaaaaaaaaaaaaaaaaaaaaaaaaaagaaaaaaagagaacaaaaaaaaaaaaaaaaacattagacggggggggcgggagcaagaaaaaattcaacgcggggggagtgaagaagggacgagggatgacgaacatatattgaagagaggagagagggccagtagcgagagagagcacagagaaggggtaggggcggcagagtacagtataaaaagccaggagagtgggggggaaagagaggaatagaaagctactgggagagaggaagaacaaggatgtaggggcgagaagagctggagagaaaaaaaaaagaagag

SEQ ID NO: 321425 - DNA, 3295 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctatttttaacatactttgaggcattaagacttatcctttaatacacaatattaactaaaatgcccatatagaacaatggttagaccatctgaacgtcg

SEQ ID NO: 321426 - DNA, 3126 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttagaaggcctgtcctctgggagtgacctttattagtccaccccttggagctagacatcctgtacttagtcacggggatggtggaagagggagaagaggaagggtgggcaccgcctccctgctctcatcccatccctagcctcatgccctccgatgctcaccccccgtttatccgcagcgcccttagctctgcgccctctgcttcctgtcttcccccg

SEQ ID NO: 321427 - DNA, 3126 bp, Homo sapiens
gggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaacccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttagaaggcctgtcctctgggagtgacctttattagtccaccccttggagctagacatcctgtacttagtcacggggatggtgggagccagatgacccagttcgccttctctccatcctcccatctcctctcattccccactcctctcagccctcgcccccccccccctctacctccctccctcccttcccctcccttcttcgcctccctctcccccg

SEQ ID NO: 321428 - DNA, 764 bp, Homo sapiens
gttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggtacgtggctgggaagccccaggatgggaaggaagaggaagcagatgccctctgaagcctccctggacggcccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgtaaaaaaa

SEQ ID NO: 321429 - DNA, 1306 bp, Homo sapiens
cctcgctgctgggtgagactagccagggagcttaggggtaaggagggcaccccctgtccaacagggagattcttaggtcagggagcacctggctggcttcctcactcaccgccgaagtgggcattggatttgacctattacgaacctggagcaggaccagggatgccctggttgctctgcagaatgtggctcagaggtaagtgatctgctcgggatacccagtcactgtgctcagagccatgcctccccgggcagccggaggacatggatgtgctctggaatgtctttaacaccctttttttgttagttcttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321430 - DNA, 5052 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321431 - DNA, 4934 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321432 - DNA, 6273 bp, Homo sapiens
  misc_feature (3739)..(3739): n is a, c, g, or t
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataagnttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321433 - DNA, 4941 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321434 - DNA, 4728 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321435 - DNA, 2364 bp, Homo sapiens
gaaaaaagcagctggaagatggccgtactactttctagactacaacatcagaaggagtacgaactgcatctatgacctgagtctagagaggtggtatgcagatcttcgtgaagaccctgaccggcaagaccatcaccctggaagtggagcccagtgacaccatcgaaaatgtgaaggccaagatccaggataaagaaagcatccctcccgaccagcagaggctcatctttgcaggcaagcagctggaagatggacgcactcattctgactacaacatcctgttggctggcgacacagccaacaggatagccaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321436 - DNA, 2304 bp, Homo sapiens
gtcccggaaccaatcctctacagataccaagggacaactttatgtttaagtgttacttttagtattttattggaggtagccaatacagtatattagtgtatactaattagtgtatacacctcagcctcccagagtgctgagattacaggcatgagccaccacacctggccgaaaacacatgttcttaaaaacatttttaaaagttagcctttctgaaaataaacattctaaaaatctatttttagctttatcacatccacctataatgtgaactcaaacagctacatgattagtagttttaattgcattcattaaaagggttttaatattcaaagatgtgcaaacatcttcttgcgtctgccatagtcttaaatatcacagaaatgagtgtaaattatgtcaaatagcatccttaataaacatgcctctggaaattaatgcagacctttttgtttatatttctatagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321437 - DNA, 1625 bp, Homo sapiens
tgacattcctaatagactagtataggaagggaggtagggctcaggaagcctggccagtggttgtttgccctgctgtattacattccttgtcagaatggtatttgtggaccacctttggaaactgatcaggaaatggagtgtattaaatcactaatatagatttgaaaataaacttaaaagcccagggtgaaaacgtgtcattgctctccgcaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321438 - DNA, 4806 bp, Homo sapiens
  misc_feature (4594)..(4595): n is a, c, g, or t
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgaggtaagggctgcctagtgggtacaggtctaaggcggggacttctcaaggactgggacttgaagaaagaatttcctttacccaaatttcagagtaacaggaggattttttccccacagattgactgtttgccttactcattccatcaaatttaattgtaaagattacagagtcaaaacttaagcatagtttgcttgtgtgctaaaactctgacaaagtgtaatcattgatgtttccagccagtacatttgacacattggagcctggttatgttacattgcacatggttagcacatgagcagaattcctacggcttagacctgttttgtcttgtttgctgactctcagccaaacttcttaattcctttgcatcatccagcaaagtcagaccgcttgtgctgccctggggtctaaagggaccgtgacaagcaaatgagcagtcttggtaaatgccacacaaacagtaggaatgttcacagtgtcttcctgttgaagttttatactggattgcttcctgcttccgagaatagaaaaaaaaaannaaagaaaaaaaaacccttgttggccgccttggcccaatcgactttagactcgagcaaacttttgcttgcgggcgcaattctggctcacttggccatttgcccttaaggaggggatttacaatcactggccggggtttaaacactcggactgggaaacccttgcgttcccacttaatggcttggggaataccccttttcaactgggggaaac

SEQ ID NO: 321439 - DNA, 3379 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggtatgacccccaagttgcagcctgggtaccgagctgaatttatcatgtcaa

SEQ ID NO: 321440 - DNA, 1171 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtaagtactgggtttgctttcagcttgccttaatagcattttggttttttgcccagaagaaaattaccccttgcttttaagcatttgacagaattacataacctagggaccgctgttcttggatcctcagtacttttggaggggtgtgaagatatgtgtaagttatcttcctacttttcc

SEQ ID NO: 321441 - DNA, 527 bp, Homo sapiens
gcggccgccaccggctctaggcaagtaccctcctctctctccctccccggcccaggtgctgcctgccgcacgccccgggagagccgccgaggcgcggcagcctgtgcccaggcgtcgccgggatgccttccctcctgtcccgactttggccagggaatgatttggtgggcgcgaattcgcgctggtgccctgggtcgtttgtgcaggcggggtgaggggcagcgcgagtaaacgggttgacatcccctaggtttctctgcagagtgcgctgtgtacttcatcgggcatttactttttcactgcttcctcatcgcccccggggcggcagcgcctcacagggtctctctgggggaatcatcaacaggtgtgcctgaacacgcacctgcggcagccacaggtgtctgggagccaccttttttcttctccctggcctggcaccctttcactcaagggatggaaactgtttcactttctgctgagcttctcttttacccgattaaaagggcctttgaatttctgttggcgca

SEQ ID NO: 321442 - DNA, 4612 bp, Homo sapiens
cgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321443 - DNA, 4969 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321444 - DNA, 4998 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaactggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321445 - DNA, 5011 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321446 - DNA, 5695 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaaaaaaaaaaaaaaaagaaaaaaaaaaaaaaaaagaaagaaaaaaaaaaaaagaaaaaaaagaaagaaaaaagacaaaagaagaagagaagagaacagaggaggagaagaagagagaaagagaggaagaaaaagagggcagaaagaaaacaaagagaggaagcgaaaagaagaagaaagaaggacgaggcaggagaaagaaaagaagagagaagtgagagagaagaaagaaagaggggaaaggagagaagaaaaggagagaggataagaaaagagaaaaaaaaaaaaacaaaaaaagcgaaaaaaaagaaagaaagaaaaagaaaaaaagaaaagagaaagaaagaaagaagaaaaagaaagaaaaaaaaaaaaagaaaaaaaagaaagagaaaggagaacgaaaaagaaaagaagaaaaagagacagcagaaagacaagagaaaagagcaggacacagaaaataacgaagagagaaaagaagagaaggaagaagaagaaagaagaaagagacagagagagaggagggagggagaaaagcggaaagaacggggaggggacgcagaggacgggggaggagaggaggcgggcgagaggggaggggagggagagggggagggaggcaggaaaaggagggaacagaaat

SEQ ID NO: 321447 - DNA, 1907 bp, Homo sapiens
gttcaacaacaacaaactgaagggggagaaaaatacaccattaccacagcaacaaattagtttatgctagacaacttgtaaagaataaattaacttccaaatgcctatagacatggatattagtgacacaagagattttagacttttggagggttcttaaaaaattgtgctttaaaggaagagactctacattggatgcagccagtttttaaaaatgtgtctgaagcatttggtgatggtttctgcctgttcagtaaagaagcaccggctcagaacctcaacttctggacttactcaagtttgcagaactcctccaaagcagtcgagtgctctgttctctctgcttggatgttcttgttgtgaatgaacctttatgtcttgtagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctatttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgtaa

SEQ ID NO: 321448 - DNA, 5510 bp, Homo sapiens
  misc_feature (3739)..(3739): n is a, c, g, or t
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaaggtatgtggcatagatatgctgctatgaggtgagagtccctgttctgaaacttttctcaagagggcagtgaatgtagtcaagccatgcccatttgaagtgatgctcacatgtgtgctaatcaagtttgaaatttcgtaaattctctgaccaagtaataaaaatgaagggacttttaaaagaagagcagaatgtgacatgtgcagccctacattcacttccctttcacttttaatgtagtaactagtgttatattccaagtacactaatcagagcttacaagatctcatgctgagctccacagcttactaaggacgtgggaaacttagagtgcagatgagaggtgaggttgagcaacttggagaatacggctaaacattaataaaaagaaaagctaatggagttagaattacttagaaaataagnttggttgagaatgtgccatcgttctgggagtttgaatgggtgatatgagaacgttagggaatttgtctaggcctctagaattggatcgcttctccctcggggagatagctcacacacagctgtgctgcagggaggagagagggagattctattacctgtggccgcttttattttagaagcttttggtgttagtatcctgttcaccagctgaactgaggtagttttgtgagacttgacagtgactattttgttgcagaattgactaagttttgctctttgagaactagatgtgtagtcaaagtatctggcatctatggagtgcttccagtttggaagggggatgcaagcttccctggggaggacaggttgaacaggacatagcttctgcctttgagggtctgagaatcttgtagaggcatggatgtgagtgtagcacaaggcagcgtgcaatgtgttgatattactaggagagtggtaccaggagaacaggctgcagaggagctggattcagaagaaaagcaagacagactgagaaagtgtggcttagccgcggtatggaggatggatggtagcacagataggctgcagggcccctaatttgagttcctgcacaaaaacgaccataatatcaacattgtaccaaagccaagtgatctcagggagaaaaataaaagatgccttccctggcgagcacatcaaggtttcagtcgcttggctgtgtccttgggaattttcttgagtccccactcccaggagccacatcagaccccactgaccgtccaacacaaattcctctagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccaaaaaaaaaaaaaa

SEQ ID NO: 321449 - DNA, 3909 bp, Homo sapiens
ggaagctcagctgcagttctacgtagaagaaaagaggcggcaaagtaggcgcgcgggctccagtgacaaaggtctcccaggcagccgcggcccctgccccaccgctgagtggcgtgcgtgcaggcccaccctctccgcctttcccgacaccccaaagtagcgctgcgagcagctgcgtctccctcccggggctcgcgcgcccagaaccctccggtctcaaggaagcaggtgacagccgccgcccacccccttcccctccccgccgctgctctctggctcgccaccgcccaactccccctgcccccaccctggattttttttccccttctctcaaacctctaaacaggaaatagcccgaatcacaataatatacgggagcagccgcggaggccgctggcgccctcccattcccggggagcttcccgcactccggcttgggtgaagtgcagccagcgacgcgcgcagggagcgcagggggacaccagcccagcagctagcgccgcgccgcccagcgccccggagagccgccttcgccctcgcccagcgcccgacaccgccggccgcggcggcggccgccaccggctctagggtgcgaagtaccacattactgtcatctccctgtgagtgggattggcaccccggctgcagctccaggagcaagtactccaggaagcacagagctgtaccagtacacggcccacgttgccaggccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaacccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggtacgtggctgggaagccccaggatgggaaggaagaggaagcagatgccctctgaagcctccctggacggcccagggaggagcatgcacactgagatggtgtttaattacggttctgactcactgtgttctctattagagcctatcttttggcctgttgggtgaactcccaaattagggaagggcaaaaaggaaggaaaggcaatattaggagagcatatgattttaggactgttagtgtttatttaatttactcttcttgtaaaaaaa

SEQ ID NO: 321450 - DNA, 1185 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgaaaaaaaaaaaaaaaaaaaaaaaatttggggggggcccgggccctaagaaagaaggtttcataaacaccacctcgggtggggcggccggcggccccagagtaggttaaggtagaccctgggccactcagggtgctcccaaaggaagagatccgcgggcacacgacacaagtcggcgggggattccccaccaaatataaaaagccgcgggggagcaccaccggcggttctggacaactccacagcggagtccgaggggcacacacggggccaacaacaagggggcccagggaggcaaataaataccgcgcgggagag

SEQ ID NO: 321451 - DNA, 2700 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacatttttcctttgagtgctttgggtgcagccgtggaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagattttttacaaagtaagg

SEQ ID NO: 321452 - DNA, 2697 bp, Homo sapiens
ttatataggctaggtacgaggcgggtggtgaatcggccgaggttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacatttttcctttgagtgctttgggtgcagccgtggaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagattttttacaaagtaagg

SEQ ID NO: 321453 - DNA, 1093 bp, Homo sapiens
  misc_feature (1038)..(1038): n is a, c, g, or t
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctaaaaaanagggggggctaagatccggggcctttccttcccctttcagggcctgggtttacgg

SEQ ID NO: 321454 - DNA, 2296 bp, Homo sapiens
cctctcccgaagcccctctgacgggttcttcgcttccctcttggccttgccttcggtgcagactcccattacagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321455 - DNA, 2346 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321456 - DNA, 1949 bp, Homo sapiens
ccgggcctgctctctcgggccctgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321457 - DNA, 1892 bp, Homo sapiens
ggggtcggtccgaattcggctctctgggcagttcctacagatgaagcagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321458 - DNA, 1873 bp, Homo sapiens
tcttagtggatcaagcagaaagaaatagctcagacctcagcaacttcaagaaagaaagaaaaaatagctgaagtgcaatggcatgatcttcgctcactgcaacctccgcctcctggattcaaagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321459 - DNA, 2400 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321460 - DNA, 832 bp, Homo sapiens
tgtgtcactttggtgttttattacttcatacttatgaagcaagagctttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctaaaaaaaaaaaaaaaaaaaaaaaatttggggggggcccgggccctaagaaagaaggtttcataaacaccacctcgggtggggcggccggcggccccagagtaggttaaggtagaccctgggccactcagggtgctcccaaaggaagagatccgcgggcacacgacacaagtcggcgggggattccccaccaaatataaaaagccgcgggggagcaccaccggcggttctggacaactccacagcggagtccgaggggcacacacggggccaacaacaagggggcccagggaggcaaataaataccgcgcgggagag

SEQ ID NO: 321461 - DNA, 1031 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcct

SEQ ID NO: 321462 - DNA, 1347 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctaaaaaaaaaaaaaaaaaaaaaaaatttggggggggcccgggccctaagaaagaaggtttcataaacaccacctcgggtggggcggccggcggccccagagtaggttaaggtagaccctgggccactcagggtgctcccaaaggaagagatccgcgggcacacgacacaagtcggcgggggattccccaccaaatataaaaagccgcgggggagcaccaccggcggttctggacaactccacagcggagtccgaggggcacacacggggccaacaacaagggggcccagggaggcaaataaataccgcgcgggagag

SEQ ID NO: 321463 - DNA, 2266 bp, Homo sapiens
atctagaggatcccgttcactttctacacgatacccctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321464 - DNA, 2346 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgatatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321465 - DNA, 2277 bp, Homo sapiens
aaatggcgcgagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaacaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttataggggga

SEQ ID NO: 321466 - DNA, 572 bp, Homo sapiens
gatcaaggatctccaaagatctttgagcatcacctcttttacttggggctggtcatgtaggcgcccccttcctggcacataacaaaatttccagactcccagaaggaaaggtgttcagcgtaaactgtattggtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttgcttacccaggatttattccccctttcatttatttcatttattcaccagatagttttagtactgtttaaggtattggggatataccaaggaataaaacaagattcctggagggagaggggaacggacagcaaacaatagacacaatacgatcgtgaggtatatagttaatgttggtgatgctcaaagatcttgggggtaccgagctcg

SEQ ID NO: 321467 - DNA, 103 bp, Homo sapiens
gcgtgagccaccacacctcacccctcctttttcttgttcccattctttctgtcagagatctttctgcctctgccagaagcccttctttttggcctttctttcc

SEQ ID NO: 321468 - DNA, 348 bp, Homo sapiens
cagccaaatgaggatctctgtaggaatggaagaaatcacacactctgctccaggagcctctgtttgccaggtcacattgctttactctggatttctaccatttgatcgaaggtcagtccagagacttgaggcccactgtggtgctgcagatggcccagtcttgccagggaaatgtgtccccttgtgtttttgccagctgcggatctgaagatgagatgtttgcatctctaacacctcactttttgtgccaaaccaggcctgcactgcaaggaatccccctacctgaacccctcttgccactgccttctaccttgtttgaaacctgaatcctaataaagaattaataac

SEQ ID NO: 321469 - DNA, 3899 bp, Homo sapiens
gttgctggttgttagtctaccaaccactcaacttcatgcataacttataatcaggaagcatggccttaacggtttttcttcgcttccttgacagcctggctgcaacaattcattcattagtcgcattccatgaggcgtggcctctgttttacctgttttcgttgttactgccacaatgtccaccaggtggtgctgttccacttctaaccgaatgaatcgcaaccgagtagggaactttatgcatgattcataagtaggcgcggcccgcttgcatccgggtttctgggggtggggcccaaggttttgttccggccccaggctcagcgtccgccatcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321470 - DNA, 1114 bp, Homo sapiens
  misc_feature (963)..(964): n is a, c, g, or t
  misc_feature (966)..(966): n is a, c, g, or t
  misc_feature (978)..(978): n is a, c, g, or t
tgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacaggggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaagacaacccggggtggttactgctggatgaggccgnnangggttgagacgngacttgtcctttcgaagtacaggctggtggctcacggattagcctgggacaagccgggcttaccttagttggaactccatttcgaatcgggggttgcatcaggaaggccaaaattaactggcgccggaccgtgtgg

SEQ ID NO: 321471 - DNA, 3622 bp, Homo sapiens
tgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacaggggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321472 - DNA, 790 bp, Homo sapiens
tgatgaggtcctccccgcgcctggagcggaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaagttaagtagcaccctgagttttcagtggcttttctaggggttccgtgcttaattcatgaggagcgtggcttttgcagctttgtctgcgtgatccgcggttagctttcccttgcaggtaccagagttaaaacctggcgtctagcaaagggatgaggcctcctacatggttcatttcttatggcctggtaatcccagataatcagccggctctggattcaaatcccatcgatcctttccagttgtgtgatctttggcaaatcgtttgtaagcctgaataatgggtatgaggataacgataagattagcttacactcgtttagctacttagcgcatttaatcttcacgacaatcctaggaggtaggtcattattaccccgcactttatacgataaggaaacctgggaccacaggaaggctaagtaatttgcctaaggtcacacaatcagtga

SEQ ID NO: 321473 - DNA, 271 bp, Homo sapiens
gacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccacaccacgccggcccagcattcacacttagctagcacagttcacgacatccggtacaccagctcaattgtatctgtctc

SEQ ID NO: 321474 - DNA, 2537 bp, Homo sapiens
  misc_feature (25)..(25): n is a, c, g, or t
ccacgctggtacgcccccgggtatntgggatatcgtcgaccagcgccgtcgctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321475 - DNA, 3339 bp, Homo sapiens
gatcaaggatctccaaagatctttgagcatcacctcttttacttggggctggtcatgtaggcgcccccttcctggcacataacaaaatttccagactcccagaaggaaaggtgttcagcgtaaactgtattggtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttgcttacccaggatttattccccctttcatttatttcatttattcaccagatagttttagtactgtttaaggtattggggatataccaaggaataaaacaagattcctggagggagaggggaacggacagcaaacaatagacacaatacgatcgtgaggtatatagttaatgttggtgatgagtgctcctcaaaggaaacaactaaaaccagacaagggaagtcggggtgtcagggagaatggtttgtagtattgatgacaatggttaaggaaggcctgagttctgcaaagacctcaaggatatgagggactagagtgccttctgctgtggaagagcctgcgcaaagatcctgaggtgggaggggtcagggagccaactcattttacggtaagtggaggtgggatccaggggaggattctgagcagaggagggacgtggcccaatttgggctttgaaaggatcctgcttgtctgtgtgccagcatcctggtggtggttgggggagtctgcatcaatcctgggtgctgttacctgaaaaaatagcaggtgttagacgaaagaacagatgtctggcccattgtttccagtctgttcctgtccacagcttccctttatgctgagcccctgccacatgcatcatcatcctggccatgtggcattgtcacagaccgtctctcctgctagcctcctaactcagggcctgggtcttccccagcattaagtaaatcagtctcaggcagacagccctttataggtgtttgggccaggtgcggtggctcacgcctgtaatcccagctctttgtggggccgaggtctttgagctcaggagttcaagaccagcctgggcagcatgacaaaaccctgtctctaccaaaaatacaaaaattagccacgcatggtggcacacacctgtggtcccagctactcgggaggctgaggtgggaggatcgctggagcctgggaagttgaggctgcagtgagccgtgatcatgccactgcattccagcctgtgtgatggagagagaccctgtctcaaaaaaaataaagatgtttgttgggtgaatgcacaaataagtgagctttgttcccccatccccaccctggaactgcactttcttaaccctttagaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321476 - DNA, 2946 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagtggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321477 - DNA, 2870 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagtgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321478 - DNA, 2777 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagcaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321479 - DNA, 2948 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321480 - DNA, 2349 bp, Homo sapiens
  misc_feature (14)..(14): n is a, c, g, or t
  misc_feature (17)..(17): n is a, c, g, or t
  misc_feature (22)..(22): n is a, c, g, or t
  misc_feature (30)..(30): n is a, c, g, or t
agctaggtagaggncgngtgtnaatcggcngagggtcaagtactatgaagatagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagcaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321481 - DNA, 3253 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataacccaaaataaaaaacgaaataaaaaaccggcgtttggggagtgcaaaaaggcttaatagggccaaggggcaactgcgtccccgcccccactttgtgtcacaagggagaaaacgcggcaccccataaaggggacataatccaaaccgcgagacaactagcgagcagcagcacagtggagaacagacgaggagaagagggagcgcaaagaagacaacgaacgcaagcagtacataacacacgacacacgaacataacgagaagacgaagagacagaaaccaaagagaagaagcaagacgactgaagca

SEQ ID NO: 321482 - DNA, 3026 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
  misc_feature (3026)..(3026): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataacaaaaaacaagaacaggatgagacacagcgatgagcaaaaggggtgcgccgcacaaaggaatcccctgagggggcccan

SEQ ID NO: 321483 - DNA, 3118 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataacctcgtgccgaattcggcacgagcccaagctggatctgagcccagcatttatcatctcagcgctgcctcccacagaagaaggaagacataatgaataaatgaaaccccatgactgtatcaacattcatcaacccattactccaaacgtggctgataaaattgggtacctgg

SEQ ID NO: 321484 - DNA, 2939 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccagcttgctcagacccagccccaccccggcctaattattagcatcatccctctactattttttaacctatcaacaacaaccatatttagctgttcccagcttgctcagacgtacagtg

SEQ ID NO: 321485 - DNA, 3224 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
  misc_feature (2759)..(2759): n is a, c, g, or t
  misc_feature (2782)..(2782): n is a, c, g, or t
  misc_feature (2784)..(2784): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccatgacagagattgtgagccgtgtgtcgaagcgaaagctgggccgccacgtgcgggcgctggtgcttgagctgtgctgtaacgacgagagcggcgaggatgtcgaggttccctatgtccgatacacatccgctgaccccgtntgctcctctaggctggccccttntnacccctctccacaccccttccagccagctgccaagctcaaggaacggttgtatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321486 - DNA, 3172 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
  misc_feature (2759)..(2759): n is a, c, g, or t
  misc_feature (2782)..(2782): n is a, c, g, or t
  misc_feature (2784)..(2784): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccatgacagagattgtgagccgtgtgtcgaagcgaaagctgggccgccacgtgcgggcgctggtgcttgagctgtgctgtaacgacgagagcggcgaggatgtcgaggttccctatgtccgatacacatccgctgaccccgtntgctcctctaggctggccccttntnacccctctccacaccccttccagccagctgccaagctcaaggaacggttgtatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321487 - DNA, 2845 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtcgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321488 - DNA, 804 bp, Homo sapiens
tagcggaccgaactctggcaggcacagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321489 - DNA, 2805 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321490 - DNA, 2629 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321491 - DNA, 3170 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
  misc_feature (2705)..(2705): n is a, c, g, or t
  misc_feature (2728)..(2728): n is a, c, g, or t
  misc_feature (2730)..(2730): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccatgacagagattgtgagccgtgtgtcgaagcgaaagctgggccgccacgtgcgggcgctggtgcttgagctgtgctgtaacgacgagagcggcgaggatgtcgaggttccctatgtccgatacacatccgctgaccccgtntgctcctctaggctggccccttntnacccctctccacaccccttccagccagctgccaagctcaaggaacggttgtatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321492 - DNA, 2458 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcaggtgataagctgtgggagaagggaaagaggccaggcatctggccaggctgctgcctctccgcccccaggcccttgccttgccttcagatgttgcatgcctaagtgtaagatgtgccttttctccaaacctccctccctcacttcccaccaggcagcctaggtttctagaatgactcattcttttttcacttttattttgatttttttttcaacacatagacaaatattaagaatattatgatgaatactcaaataccattcctcacctaaatttaacaattcttaatgttttgccacattttcttcttagatttatgtagatttttcttctttgtgcttaaatgtgtcacagacatcacagccctttactccctactatttcagtgcctctgccaagtgaggatatgttgctgtagaacagggtttcttagcttcagcactactgacatttggggctggttatttatttgtcatgggagaggggatgccctgtgcactgtaggatgtttctcagcattcctgacttctgcccactagatgccaatagcactctccctccatcatgacatctcaaaatgtctccagacattgccagatgtccccaggggtgccacatcactcccagttgagaactacttctgtctaacagaaacatcattttcatgctcagcaaaattaacaatcattcttaccatctcttctagttatttatttgtctctaatggtccatattcaggttttccccagctgttactcaaaatgagtttaacagctggtttgtcaggatgattctgtgtgtatggtgcatttatctacagaacagtgcatatattatctagctcggggtgtccaatcatttggcttccctgggccacattggaagaagaattgtctcgggccacacataaaatatactaatactaacgatagctgatgagctgaaa

SEQ ID NO: 321493 - DNA, 1494 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctatatgacctggataactagaagaaaagatgtgcttggtgagt

SEQ ID NO: 321494 - DNA, 236 bp, Homo sapiens
cctcaaaccctctggtttgggaatagagaatgcttacgcttgaaaatcttcagtttggagactcaggtatgtttagaaactaagccacagctcagctttgccaaacagttcacagtgtgtatgttatggtgggggcctgagcaaatgttgaggtaggaagggtgtagattgtttttctgctgggggtgggggatctttagctcctctgcagagtttctgtcccagactcctgcttg

SEQ ID NO: 321495 - DNA, 252 bp, Homo sapiens
tagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttcc

SEQ ID NO: 321496 - DNA, 260 bp, Homo sapiens
ctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactccca

SEQ ID NO: 321497 - DNA, 358 bp, Homo sapiens
gacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaagg

SEQ ID NO: 321498 - DNA, 355 bp, Homo sapiens
gtgggaaggaggtggcggctccccactcgagggctgatgtgctcacccttccctgccctgccttctcctagcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttggtgagggtgtttggccagttggccaggagtcaccccacatgtccccggcctagtccagcctccccaccagtcctctacccctggttctgctctg

SEQ ID NO: 321499 - DNA, 366 bp, Homo sapiens
gctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgtgagtttggaggcgggtgaggtggtcacgggcaaagttgtgtgtgtttcggtgtgtatataccaagaggggtgtccgtctttctgtcctctcctgatgtttctttcctagctctcgctttgtgctccccacaggcatgtacatggaccgccgctgtgtctactaccggaagccactgctggagtcaggcacactgggcaccaaaggcaatgtgcagg

SEQ ID NO: 321500 - DNA, 896 bp, Homo sapiens
tggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgcatatggcaaggccaaggactctgaactcactttccctggaggtgggggtgctatcagctgcttaatggagcatcatggaaaatgtgggactcaaggcctgaaggactccattcctaagagatgggagcaggagacatgctacggagtttgaatcttgcctagcacagggatttctgcctgctggaagggctctgtcagggcctagtggaagcccctgcctcagtggggcaaactgccactggacacacccatcattcatcatcacctctctgggacagtagtagcagccaggcacctccaaagagcttgacaacagaggaacccgcttcggcccctcctctgaagacaggatcctgcgctactccaactctgaactggttcaaggtgagagacgtcatccacagaggccacaaaaccaagaggtggatgcctcattgttacttcatgctgtctgggagcaaagagagggccttaggcacaaatcctccaacccgcatctgccctggcgggatcctcagatcacccgcc

SEQ ID NO: 321501 - DNA, 3000 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321502 - DNA, 2572 bp, Homo sapiens
  misc_feature (14)..(14): n is a, c, g, or t
  misc_feature (17)..(17): n is a, c, g, or t
  misc_feature (22)..(22): n is a, c, g, or t
  misc_feature (30)..(30): n is a, c, g, or t
agctaggtagaggncgngtgtnaatcggcngagggtcaagtactatgaagatagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321503 - DNA, 2443 bp, Homo sapiens
  misc_feature (14)..(14): n is a, c, g, or t
  misc_feature (17)..(17): n is a, c, g, or t
  misc_feature (22)..(22): n is a, c, g, or t
  misc_feature (30)..(30): n is a, c, g, or t
agctaggtagaggncgngtgtnaatcggcngaggttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321504 - DNA, 2975 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321505 - DNA, 2251 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaatgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321506 - DNA, 1129 bp, Homo sapiens
cactatcatattcatcggcgtaaatctaactttcttcccaccaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321507 - DNA, 2831 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgacaggctctcaggaccgagctgctgtggccacattcctgcagtctgtgcaggtccccgaattcacccccaagtctggt

SEQ ID NO: 321508 - DNA, 949 bp, Homo sapiens
ctagaggatccctgtctttggcaggcaagccagcccagacaagctccggatcaagatgtaccccactgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321509 - DNA, 2758 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaaggcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321510 - DNA, 2890 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagatagagcatggacacgcgcatgggcatgctggccgcaagggcagaagtcctgagcaccggatgcctgccagtctctgtgccgcagcatgtcgaagtcccacaaggaacacggggtggacacgagccagcaagacaccgaggatggggtgccgcggcgcggtcagcagccagcatagtgaggagccattcaacgtcgcagagagacgctgggagggcgaggcccgaagctgcgccatagggaacaaaacgaggcgagtcgacgggactgtgctgacgagttggcaccccgatggtccgagtaccaacctaatcccggagagaccacggcctggaacccacggacgcatggggcgccacgaaccggccatgcgca

SEQ ID NO: 321511 - DNA, 2681 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagc

SEQ ID NO: 321512 - DNA, 1848 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
  misc_feature (1782)..(1782): n is a, c, g, or t
  misc_feature (1784)..(1784): n is a, c, g, or t
  misc_feature (1790)..(1790): n is a, c, g, or t
  misc_feature (1795)..(1795): n is a, c, g, or t
  misc_feature (1799)..(1799): n is a, c, g, or t
  misc_feature (1802)..(1802): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacnanctcagnagcgncgtnctnccttggtcctatttttttcctcaggagtcagctgtgaccatagtcg

SEQ ID NO: 321513 - DNA, 1462 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagctccgttataaggatccgctaga

SEQ ID NO: 321514 - DNA, 1397 bp, Homo sapiens
  misc_feature (24)..(24): n is a, c, g, or t
  misc_feature (31)..(31): n is a, c, g, or t
  misc_feature (35)..(35): n is a, c, g, or t
  misc_feature (37)..(37): n is a, c, g, or t
  misc_feature (46)..(46): n is a, c, g, or t
cctctagacggatcccgcactgantgttcgntgangncttccttangtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataac

SEQ ID NO: 321515 - DNA, 483 bp, Homo sapiens
gccggccgcccaacagggacgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttggatgttggtctactaggtgactgtctcctggaaatgttatgcagctcagcaaggtgaaggtgagaatatctttgctttttgataaaacacagaatgcatagatttcacatctcactatgtgagcccccacaaaacaaaacctagaggagcatgtgagaaaaacgcatctctagg

SEQ ID NO: 321516 - DNA, 1269 bp, Homo sapiens
cctgcgccgccgccgtcaaactcccgcagacttctctgtagattgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaagaatgatgcgtacagttttgtctagctgttttaaatattcccgatacgcgggc

SEQ ID NO: 321517 - DNA, 1916 bp, Homo sapiens
  misc_feature (1496)..(1496): n is a, c, g, or t
gccggccgcccaacagggacgcgagccgggaccacgccgacccagcgtgcccaggccgaggaaagcgcggcggcggcagtccgaagacccaccgggactgaaagagaaggacgaggtcatcttcggacgggaggggcaagccagccatcctgggaccccaggcgtgcaggttctctttgagggtattccaccctgcaaaaagcatgtattcatggtcagctctcagcaaggccagtagcagagtggtaaaggccttggccctccaaggctgggaaaagacaatgacaagtcaaatccagacctatgttggatgttggtctactaggtgactgtctcctggaaatgttatgcagctcagcaaggtgaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321518 - DNA, 2069 bp, Homo sapiens
  misc_feature (1649)..(1649): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321519 - DNA, 2107 bp, Homo sapiens
  misc_feature (1687)..(1687): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccaggtttgtgttcctggacagcgtccgttttcctggtgggttttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321520 - DNA, 1631 bp, Homo sapiens
  misc_feature (1211)..(1211): n is a, c, g, or t
aatgacggctaggtacgaggcctgggggtaaaatcggccgagggttttgctggaggtcgcaaccaggccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321521 - DNA, 2191 bp, Homo sapiens
  misc_feature (1771)..(1771): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgttagcatttatggatatgaactttgaagggtttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagacctttgttaataatgtataatttgaaaataaagacagtacttcattccttgttaaaacaagctcgttaaccagtctaagagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321522 - DNA, 1618 bp, Homo sapiens
  misc_feature (1198)..(1198): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccattaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321523 - DNA, 1606 bp, Homo sapiens
  misc_feature (1186)..(1186): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321524 - DNA, 1969 bp, Homo sapiens
  misc_feature (1549)..(1549): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcatccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321525 - DNA, 1045 bp, Homo sapiens
  misc_feature (625)..(625): n is a, c, g, or t
atgaaattaagaaataattgttaatttattacatataggtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321526 - DNA, 855 bp, Homo sapiens
  misc_feature (435)..(435): n is a, c, g, or t
tggtaaagagttggagtttatattcctggagggtcttgaagaaagacacagagaaactgacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321527 - DNA, 455 bp, Homo sapiens
tctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccaggtttgtgttcctggacagcgtccgttttcctggtgggtcgtctatttatctctcgcctagacttcgattagaagaggcccttttcaatcattttgtccagtca

SEQ ID NO: 321528 - DNA, 366 bp, Homo sapiens
tataatcattttctagaaagtatgggtatctatactaatgtttttatatgaagaacataggtgtctttgtggttttaaagacaactgtgaaataaaattgtttcaccgcctggtatattgggtttttgtttttttaagtagcttcaactctatatagtagtctgggattacaactggtcatttgcctaattaaattgccttatttttagtgatggagaaaaataatacctcttatctgtcatagccttataacagttctccagtgtatgaactggctgcatgagaatccatggagatttggtttagaatacaaatttcagggttcaactgtggtgattttaattaaaacttaagaaaccaccactt

SEQ ID NO: 321529 - DNA, 903 bp, Homo sapiens
  misc_feature (710)..(710): n is a, c, g, or t
  misc_feature (714)..(714): n is a, c, g, or t
  misc_feature (716)..(716): n is a, c, g, or t
  misc_feature (724)..(724): n is a, c, g, or t
  misc_feature (728)..(728): n is a, c, g, or t
  misc_feature (742)..(742): n is a, c, g, or t
  misc_feature (758)..(758): n is a, c, g, or t
  misc_feature (766)..(766): n is a, c, g, or t
  misc_feature (768)..(769): n is a, c, g, or t
  misc_feature (772)..(772): n is a, c, g, or t
  misc_feature (780)..(780): n is a, c, g, or t
  misc_feature (797)..(797): n is a, c, g, or t
  misc_feature (799)..(799): n is a, c, g, or t
  misc_feature (803)..(804): n is a, c, g, or t
  misc_feature (819)..(819): n is a, c, g, or t
  misc_feature (825)..(825): n is a, c, g, or t
  misc_feature (827)..(827): n is a, c, g, or t
  misc_feature (831)..(831): n is a, c, g, or t
  misc_feature (838)..(838): n is a, c, g, or t
  misc_feature (840)..(840): n is a, c, g, or t
  misc_feature (843)..(843): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaatgaactagttaacatgatctggtgcttaganagangnttctgganaaangactgatacaagangttcctggatgtgggnagctgggntnnacnttgtggtntgtgttcctctggggtngnaaanncaaaaagggggtacngtgtgngngaanggggacngngtnggaacggatttttaaattgaaaggcgagaaattgaaagaggggttgaggcacaggtaaca

SEQ ID NO: 321530 - DNA, 1677 bp, Homo sapiens
  misc_feature (1257)..(1257): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321531 - DNA, 1678 bp, Homo sapiens
  misc_feature (1258)..(1258): n is a, c, g, or t
cctgcgccgccgccgtcaaactcccgcagacttctctgtagattgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321532 - DNA, 1781 bp, Homo sapiens
  misc_feature (1361)..(1361): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321533 - DNA, 2137 bp, Homo sapiens
  misc_feature (1717)..(1717): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgttagcatttatggatatgaactttgaagggtttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagacctttgttaataatgtataatttgaaaataaagacagtacttcattccttgttccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321534 - DNA, 1566 bp, Homo sapiens
  misc_feature (1146)..(1146): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321535 - DNA, 1416 bp, Homo sapiens
  misc_feature (996)..(996): n is a, c, g, or t
acccacgcgtcgcggacgcgtgggtcgacccacgcgtccgactgtagatcgctgagcgatactttcggcagcacctccttgattctcagttttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtaaaaaaaaaaaaaaaaaaaaaaanaaaaaaaaaaaaaaaaaaaaaaagaaaaaaaagaggaaaaacgaaaagtacaaaagaatataataacagaaagaaaaggacacaataagagatgaacacaagaaacaacacaacaaaaagaaaaacaaaagaaggcaacacacacaaaaaaagaacaagacaacagaagacagagagagacagcgcgggagcaggagccgacgggacgagctactatccaacaacaagagaagagcgccaccagcgcagaacaaagccacagagccgccaccactggacgagccacatcttggaagaacggagagcaagacacaaactaaagatcaggcgggacgagcgacaacaaaaaagggcgaggaacaaacgcaccaactaaccacgaaggacatcaacagacggctaccagaggcaccacattac

SEQ ID NO: 321536 - DNA, 670 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcattagcctcaccaaacatattgctcaggcctataaaacaaaaggttctagttttgactcttctgtaaggtacttgagggccaagcccatctgggccca

SEQ ID NO: 321537 - DNA, 845 bp, Homo sapiens
cccaccgaagtgtgtcagtctttggaggtccgtcactggccctcccggaggggccgaaggaaaccgcggaaacgaaagggctgggttagggcccggggcagttacacgggccgggccggagtctcaggaccacggggttggctctggccctgtctctgcttcagggtccccggcccgcgctctggccgccagagccaagttggaagaagagtctgaagcgggttcgacttgggacaggggaaaagcggggccctttccgctgctggtccgccccaggatttgcgagcgtcctgggcgcgaaagtccacgagaagtgcagaaggggctcggggatttgttgattggggtggggcgggggagtttgggtaaagaagttgcctggggaatgacactctcccctccacaacagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcaggtaaggacctggagtggaaaaggcgaggagtgagccttactcaaatctaggaaggactgtgctccaccactgttaaccgaagtaattttggggggtacctgatggaactgataggcttggatggggcctgtagggtctgctataagcaacagagaagaggtcggctggctaactaggggcaaggacttagac

SEQ ID NO: 321538 - DNA, 394 bp, Homo sapiens
aatttgttgtttttgttttgttttgagatctgtttttcaactctgtcaacaggctggagtgtagtggtgtgatgatagctcacttgcagtcttgaactcctagactcaagggatcctctttcctcagcctcctgagcagctgggactacatggatgcaccactcagctaattttaaaattttttcgtacaggcagtgtctcactatgttgcccaggttggtctggacaccacacctggccctagatcagtaatttgtatcaaaatcacttagggttggatgtggtggctcatacctgtaattccagcactttgggaggcctaggccagaggatgacttgaggccaggagttagagaccagcaggagcaacaaagcaagaccctgtttctacagg

SEQ ID NO: 321539 - DNA, 1839 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321540 - DNA, 1845 bp, Homo sapiens
agaaaaacaaatcaggctaaggtacgaggctcggggtggttcagggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321541 - DNA, 2124 bp, Homo sapiens
cccaccgaagtgtgtcagtctttggaggtccgtcactggccctcccggaggggccgaaggaaaccgcggaaacgaaagggctgggttagggcccggggcagttacacgggccgggccggagtctcaggaccacggggttggctctggccctgtctctgcttcagggtccccggcccgcgctctggccgccagagccaagttggaagaagagtctgaagcgggttcgacttgggacaggggaaaagcggggccctttccgctgctggtccgccccaggatttgcgagcgtcctgggcgcgaaagtccacgagaagtgcagaaggggctcggggatttgttgattggggtggggcgggggagtttgggtaaagaagttgcctggggaatgacactctcccctccacaacagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321542 - DNA, 1859 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggtacccaggctctgaactaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321543 - DNA, 1945 bp, Homo sapiens
  misc_feature (1744)..(1744): n is a, c, g, or t
  misc_feature (1878)..(1878): n is a, c, g, or t
  misc_feature (1908)..(1908): n is a, c, g, or t
  misc_feature (1912)..(1912): n is a, c, g, or t
  misc_feature (1914)..(1914): n is a, c, g, or t
  misc_feature (1919)..(1919): n is a, c, g, or t
  misc_feature (1922)..(1923): n is a, c, g, or t
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcaaaaaaaanatcatgaatggacacttgggttgcttccacctcttggctattgtgaataatgctgctttaaacatggacgtacaaatagctctaagaacctttccattctttttggatatatacccagaagtagaattgctgantcatataattctaaatttttagctcatacntttntncatancanntgcccttttacatttccacgtg

SEQ ID NO: 321544 - DNA, 1029 bp, Homo sapiens
agcgtgtaggtgacgtggccgcttccagtctttggtcgggtttcggcggctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321545 - DNA, 1268 bp, Homo sapiens
gggattcaaacccagagcatgtgggctttgaacctgcttttaactgttaaggtgtgccacatcctgttttctcccccaggcggtggtgctgtggttctgggggcagagtcccatgcctccaaggatgtcgccatcgacatgatggactctcggaccagccagcagctgcagctcattgacgagcaggtacccaggctctgaactaggtagaatcagcttctccattatcctctgtggttcccgagagagtgtttggagtgtgccatgggcagaatggcaagctgggagggttgtaaaaatgcaggtctgaccctgaagaagctgttggtgctcatgtgctctctccctctcctgaagggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321546 - DNA, 964 bp, Homo sapiens
tatagctgttcttgaggatcacctggatgtgctgtctcagcagtagagagggtcgattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321547 - DNA, 1225 bp, Homo sapiens
gcaatggtctgtgaacatttttccccttacaataaatataatacatactcaccagataaaaatgtaaatactgatgaggaaaaattgtaactaacattttcggggctcttgtgggttagggactttatactaactcattgaagacagcgacagtagcctgagagaaggtagggtttgggttatcctcattttgccggtgaggaaaatgaagcttgaagttagactaacttagagtcttaagctaataaatggcagagttggttttcaaaccagaaataacttgtttatagtacccttccaaagccttttctatacacaaatatatataagaatgggatcatattgtgaccatctttccatgtcaataaatggacttcaacagcattctttttaatccagtgtccttttgtttcctcttctcccggccttgtccccaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321548 - DNA, 2538 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttcactcactgtgaaggtggctccgtcgtgccgaattcggcacggaggggccggcttcagctcgctcggggcatcgtaatgtgctatgcccgtactgtgccgcgctgtagtataggcaaggtggccgcgctggcatggcctggcggctgcactgggagtcccgccggtgtactgtcgtctcgcttggttccctccaggtctgcgcctactggtgtcttgcagatctgcctggatctccgcatgtctcacgctgggatccttgcttcaagcacgaccaacataggataccttgtttcccccacttgacaaagcataggctacgggcaaggcaacgccaaggcaaatggccgaacaatttctggccgcgcatccatggattgctgtggcggtgtgggaaagaaaataaagagagagtgacgcaagagaaggtggcgcagagagaggagaaacaaggacgagaaaacacacgagagagccacagaagagattgtttctgtgaacaaagggtcgtggggaaaaacacacagcggcgggcgccacaccaaccaacaaagaatgagagggcaaaagacaaaagaaggacacaagacaatagaacaccagcctgaagccaacaaccagggcaaagtataagagatgcagagcaagaaacagagcaacagcaagaatggagcaacagcagcacagaagcaaagcaaaagaagaccactgaaacagagacaaaagacagaaagacagaagaaagagaaaaagacgcaaagaaagaacaacggaaaagacaacacagagtgcgcaaaagagtagagaagaaagagagaacacaaaagacaccagaagagaagcaaagaacacagagcagaaaaagacaaaggatataaaaaaatagaggaggagacgaatacacagaaagaacacaagcaaggaagaaagcgaaaaaaagagtgactgtgcgaagctgcaaccg

SEQ ID NO: 321549 - DNA, 974 bp, Homo sapiens
  misc_feature (773)..(773): n is a, c, g, or t
  misc_feature (907)..(907): n is a, c, g, or t
  misc_feature (937)..(937): n is a, c, g, or t
  misc_feature (941)..(941): n is a, c, g, or t
  misc_feature (943)..(943): n is a, c, g, or t
  misc_feature (948)..(948): n is a, c, g, or t
  misc_feature (951)..(952): n is a, c, g, or t
agaaggtgaaaggaagtgggctccggggcataaatcaaggcttggctctaagaggagctggcgataggtgggaagacagaggctattgtagcaatgctcggggtggagcggcatttatcttcagaccacttcagtcttctcagtcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcaaaaaaaanatcatgaatggacacttgggttgcttccacctcttggctattgtgaataatgctgctttaaacatggacgtacaaatagctctaagaacctttccattctttttggatatatacccagaagtagaattgctgantcatataattctaaatttttagctcatacntttntncatancanntgcccttttacatttccacgtg

SEQ ID NO: 321550 - DNA, 1543 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggtgagatacactctctcgccccaaacagaggagctttctcttccccgtggattggcatcttaaagtccccagggactgcttgatgccttttggaagatagagtgaattctgcccacccatgggacccagttcacctgcttccatccacccaacaagtttttattgagcacctgttcatgtgaggcactgttccaggtgcgggagatacagtggcaagtagaacagtaaagtctgtctggagctgctttgtagcatgtgtaagtgtatggaatttgatagggcagatgaggacagctgtggaaaagaactgacaaggctggcacagtgactcacacctgtaatcccataggcagcactttgggaggccgagcaatgcagatcgcttgagttcaggaattcaagaccagtttgggcaacaaagcaagaccctgtctctacaaaaaaatacaaaaactagctgggcatggtggcatgggcctgtagtcccagcta

SEQ ID NO: 321551 - DNA, 1715 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggtacccaggctctgaactaggtagaatcagcttctccattatcctctgtggttcccgagagagtgtttggagtgtgccatgggcagaatggcaagctgggagggttgtaaaaatgcaggtctgaccctgaagaagctgttggtgctcatgtgctctctccctctcctgaagggattcctacatccagagtcgggcagacaccatgcagaacattgagtcgacaattgttgagttgggctccatctttcagcagttggcacacatggttaaggaacaggaggaaaccattcagaggtgagatacactctctcgccccaaacagaggagctttctcttccccgtggattggcatcttaaagtccccagggactgcttgatgccttttggaagatagagtgaattctgcccacccatgggacccagttcacctgcttccatccacccaacaagtttttattgagcacctgttcatgtgaggcactgttccaggtgcgggagatacagtggcaagtagaacagtaaagtctgtctggagctgctttgtagcatgtgtaagtgtatggaatttgatagggcagatgaggacagctgtggaaaagaactgacaaggctggcacagtgactcacacctgtaatcccataggcagcactttgggaggccgagcaatgcagatcgcttgagttcaggaattcaagaccagtttgggcaacaaagcaagaccctgtctctacaaaaaaatacaaaaactagctgggcatggtggcatgggcctgtagtcccagcta

SEQ ID NO: 321552 - DNA, 560 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcaggtaaggacctggagtggaaaaggcgaggagtgagccttactcaaatctaggaaggactgtgctccaccactgttaaccgaagtaattttggggggtacctgatggaactgataggcttggatggggcctgtagggtctgctataagcaacagagaagaggtcggctggctaactaggggcaaggacttagac

SEQ ID NO: 321553 - DNA, 304 bp, Homo sapiens
tggcaaagcgcaagtccctctttgatgataaagcagtggaaattgaagagctaacatatatcatcaaacaggtgagctactagccatcaggagagcccagcattccaatcagatcacttctgtcttcctgtcattttccattgccatggggacccagagcaagtttctttttttagagaggggggtctcactgtgttgaccagtctggagtgtagtggtgtgacctagctcactgcagcccttaactcctggcctcaagctttcctccagcctgagcctcctgagtggtagagactacagggac

SEQ ID NO: 321554 - DNA, 1992 bp, Homo sapiens
  misc_feature (1791)..(1791): n is a, c, g, or t
  misc_feature (1925)..(1925): n is a, c, g, or t
  misc_feature (1955)..(1955): n is a, c, g, or t
  misc_feature (1959)..(1959): n is a, c, g, or t
  misc_feature (1961)..(1961): n is a, c, g, or t
  misc_feature (1966)..(1966): n is a, c, g, or t
  misc_feature (1969)..(1970): n is a, c, g, or t
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcaaaaaaaanatcatgaatggacacttgggttgcttccacctcttggctattgtgaataatgctgctttaaacatggacgtacaaatagctctaagaacctttccattctttttggatatatacccagaagtagaattgctgantcatataattctaaatttttagctcatacntttntncatancanntgcccttttacatttccacgtg

SEQ ID NO: 321555 - DNA, 2044 bp, Homo sapiens
  misc_feature (1784)..(1784): n is a, c, g, or t
  misc_feature (1835)..(1835): n is a, c, g, or t
  misc_feature (1843)..(1843): n is a, c, g, or t
  misc_feature (1977)..(1977): n is a, c, g, or t
  misc_feature (2007)..(2007): n is a, c, g, or t
  misc_feature (2011)..(2011): n is a, c, g, or t
  misc_feature (2013)..(2013): n is a, c, g, or t
  misc_feature (2018)..(2018): n is a, c, g, or t
  misc_feature (2021)..(2022): n is a, c, g, or t
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcanaaaaaaaaaaaactcgagtttttttttttttttttatatcacattttggtnaaaaaaanatcatgaatggacacttgggttgcttccacctcttggctattgtgaataatgctgctttaaacatggacgtacaaatagctctaagaacctttccattctttttggatatatacccagaagtagaattgctgantcatataattctaaatttttagctcatacntttntncatancanntgcccttttacatttccacgtg

SEQ ID NO: 321556 - DNA, 1987 bp, Homo sapiens
  misc_feature (1784)..(1784): n is a, c, g, or t
  misc_feature (1835)..(1835): n is a, c, g, or t
  misc_feature (1843)..(1843): n is a, c, g, or t
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcanaaaaaaaaaaaactcgagtttttttttttttttttatatcacattttggtnaaaaaaanatcatgaatggacacttgggttgcttccacctcttggctattgtgaataatgctgctttaaacatggacgtacaaatagctctatctaaattttagaaactaaactttcttcataacacctgaacccctttaacttttccgtgc

SEQ ID NO: 321557 - DNA, 1936 bp, Homo sapiens
cccaccgaagtgtgtcagtctttggaggtccgtcactggccctcccggaggggccgaaggaaaccgcggaaacgaaagggctgggttagggcccggggcagttacacgggccgggccggagtctcaggaccacggggttggctctggccctgtctctgcttcagggtccccggcccgcgctctggccgccagagccaagttggaagaagagtctgaagcggtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321558 - DNA, 1690 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagcagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321559 - DNA, 2002 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcaggctggagtgtagtggtgtgatgatagctcacttgcagtcttgaactcctagactcaagggatcctctttcctcagcctcctgagcagctgggactacatggatgcaccactcagctaattttaaaattttttcgtacaggcagtgtctcactatgttgcccagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321560 - DNA, 1853 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagcagtgaccctcgtccctccccctcccgacaccatgtcctgccgggatcggacccaggagtttctgtctgcctgcaagtcgctgcagacccgtcaggctggagtgtagtggtgtgatgatagctcacttgcagtcttgaactcctagactcaagggatcctctttcctcagcctcctgagcagctgggactacatggatgcaccactcagctaattttaaaattttttcgtacaggcagtgtctcactatgttgcccagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321561 - DNA, 1883 bp, Homo sapiens
agaaaaacaaatcaggctaaggtacgaggctcggggtggttcagggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagagtgtccttttgtttcctcttctcccggccttgtccccaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321562 - DNA, 1096 bp, Homo sapiens
gggattcaaacccagagcatgtgggctttgaacctgcttttaactgttaaggtgtgccacatcctgttttctcccccaggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtgga

SEQ ID NO: 321563 - DNA, 1793 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctataactccgtggtctccgcaaagtattccaagacaaagtgcttggtccgtgt

SEQ ID NO: 321564 - DNA, 1414 bp, Homo sapiens
agcgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactctgtatgattcccgggggggcttcccttcgccgttcccccgcgggtgcacggtcgtccgcgggggcctcggggccggcgggac

SEQ ID NO: 321565 - DNA, 1362 bp, Homo sapiens
cccaccgaagtgtgtcagtctttggaggtccgtcactggccctcccggaggggccgaaggaaaccgcggaaacgaaagggctgggttagggcccggggcagttacacgggccgggccggagtctcaggaccacggggttggctctggccctgtctctgcttcagggtccccggcccgcgctctggccgccagagccaagttggaagaagagtctgaagcgggttcgacttgggacaggggaaaagcggggccctttccgctgctggtccgccccaggatttgcgagcgtcctgggcgcgaaagtccacgagaagtgcagaaggggctcggggatttgttgattggggtggggcgggggagtttgggtaaagaagttgcctggggaatgacactctcccctccacaacagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagtagagatggggtttcaccatgtcaggctggctttgaactcctgacctgaggtgatctgccctcctcagcctcccaaagtgctgggattacagaatggactccagaccaaataagccagcttctgcgtgcctgtccgaaacaaacgcacgccgcacaattcaccctcatggcccaacgccgcatcgggaaacgacctcagcaaacaacacttccgcaacgctggcagacagcgtggccaaccgtctgcgcaaggcgccagctccctcctgacgaccgatcacaagcacgcggacaccttcgacgagcctcaccaatctatgcatcgcaacgccgggagcatcaccagccctcacgcgcgaacaaagcgagatcaagcaccaagggataccgatgagcagcccacagcggcagcccagcagcgaccccgcccctgcaggacccactccaacaccaaaggagaacactgcacgcacgcaaacgggcatcatacgctcacggacctccaacaggtccgcacgcagccgaacacctgcacccaacagaacggagaggcgcgacacccgcgaacgggactgacaagcactggacactaaccacggagaggccagcgacgggaaaacaagacacaggagcacacacaaagaccgggacaaagaacaaggaggccacacagggaccgcaaagccgggagactcccacccacagcaaa

SEQ ID NO: 321566 - DNA, 1657 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321567 - DNA, 430 bp, Homo sapiens
  misc_feature (8)..(8): n is a, c, g, or t
cgggtcgnctactactactactaaattcgcggccgcgtcgacagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccaaaaaaaaagtcgacgcggccgcgaatttagtagtagtagtcgacc

SEQ ID NO: 321568 - DNA, 1546 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321569 - DNA, 1803 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaacaaacaacaacctctcccaaacaaagaaaattgggggggcgcgacgcccaaaaaatttaaacacaccgcggggggggggcccctgtagcaccggcccgggtcagagaaccggcaaaagggggttccccaaaaaagg

SEQ ID NO: 321570 - DNA, 1628 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgaacactgcatgttctgaataagttctaactgaggcttaattcataagagatatttgtc

SEQ ID NO: 321571 - DNA, 2207 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacagaaaaaagaacaaaaaaaaaaaaagacaacaacaacaaccaaagaagagacacgcgcgcggcgccggccgcgcgccgccgcgacaattgaagacaaaaatactacaacgcgggaggggacgacgggaggccaggcacgccaacagaggatgagagagacacgggaacgcacaagatcacatgagcaaatcagaaaggaaaagcaccaaccgacaggcacgaacgaatggcaccggccgagagccagacaacacccacacaccacacacgacagaacacacgcccgcggcagaggaaggacacgcgcaccggcagctcaaaggcaaaacaacacatggaagccaggcgagcagcacgcgaggagcaagacaacaaacgacgggaagacaagacagaccaggaaggcggagccggaccagagacgacaaaaaacaacagaccccgacccggcaagagggggggggct

SEQ ID NO: 321572 - DNA, 1433 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggatccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321573 - DNA, 1472 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaagtaaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321574 - DNA, 946 bp, Homo sapiens
  misc_feature (860)..(860): n is a, c, g, or t
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaagtaaactcacttgtctgggccagaaaaatccaatggtccagaattttttaccagagggccagtttaagaaacgaaaatttcagaaaggcggaggaaataacactgnaagccggaaggggaggtcccgttaaaaaaaaggcggcggaatggcggggggtgtttttctactatctatcgctccttactccctta

SEQ ID NO: 321575 - DNA, 364 bp, Homo sapiens
  misc_feature (8)..(8): n is a, c, g, or t
cgggtcgnctactactactactaaattcgcggccgcgtcgacacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaaaaaaaaaagtcgacgcggccgcgaatttagtagtagtagtcgacc

SEQ ID NO: 321576 - DNA, 1477 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321577 - DNA, 2417 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcacaaaaaaaaaaaaaaaaaaaaaaaaaaagtgtgttgcggccgcgcccgggccccccgaaaaagttttcaagaaccaatcgcgtgggggcgcgcggggccccaggtgggaaggggaaacaggggcacacaagagcggtcccagaggaaaaccggggccaagagaacaaagggctgtgggttccccccaaaaaaaaacgcgcccgcgggggaaaccgcggagggcgttggggaacaaaatccgaagggaggtgccgggagaccacagaggggaccaataacaggggggtcacaagcagagcccgaaatctaaaatttggccccccgagcgggagaagaaagaagcagaagagagaacaacaacaaagagaaacaagaaagcaaagagatgagaacaaaaagcaagcacaaacgaacagaggaagcgaaacacagagaacagaatccaaagacacatcatccaggacaggcgacgcgaagagaacggagggacgaggagcaagagaggagaggggaggggagaggagggaggcggagggaagagggacggggagaggaggaagggggagagggacggcaggagaggcgagagtgcgagggaaggagcggcggagcagacgagagggcgaaagggagggatggagaaggagaggagagaggggggcgaggtgaggagcagagggaccgagggagggagaggggagaggagggagagggaggcagtgagggcacggaagaaaggaagaggtgacgagaaggagaa

SEQ ID NO: 321578 - DNA, 1625 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321579 - DNA, 2237 bp, Homo sapiens
caaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcacaaaaaaaaaaaaaaaaaaaaaaaaaaagtgtgttgcggccgcgcccgggccccccgaaaaagttttcaagaaccaatcgcgtgggggcgcgcggggccccaggtgggaaggggaaacaggggcacacaagagcggtcccagaggaaaaccggggccaagagaacaaagggctgtgggttccccccaaaaaaaaacgcgcccgcgggggaaaccgcggagggcgttggggaacaaaatccgaagggaggtgccgggagaccacagaggggaccaataacaggggggtcacaagcagagcccgaaatctaaaatttggccccccgagcgggagaagaaagaagcagaagagagaacaacaacaaagagaaacaagaaagcaaagagatgagaacaaaaagcaagcacaaacgaacagaggaagcgaaacacagagaacagaatccaaagacacatcatccaggacaggcgacgcgaagagaacggagggacgaggagcaagagaggagaggggaggggagaggagggaggcggagggaagagggacggggagaggaggaagggggagagggacggcaggagaggcgagagtgcgagggaaggagcggcggagcagacgagagggcgaaagggagggatggagaaggagaggagagaggggggcgaggtgaggagcagagggaccgagggagggagaggggagaggagggagagggaggcagtgagggcacggaagaaaggaagaggtgacgagaaggagaa

SEQ ID NO: 321580 - DNA, 1532 bp, Homo sapiens
  misc_feature (8)..(8): n is a, c, g, or t
cgggtcgnctactactactactaaattcgcggccgcgtcgaccccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataagggcttaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttca

SEQ ID NO: 321581 - DNA, 367 bp, Homo sapiens
tggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcctctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgcggtgtttg

SEQ ID NO: 321582 - DNA, 400 bp, Homo sapiens
cgccgccgcgctcgctccccgcgtgtggacgccaggggccgaagtaaaagccccgagcccgcggctgcgctcgggaaactttgcccgaggagaggacagcaaagaaaaatcacccgaagttgagagctgagcctccaagttacagctccgcagcgggcgaggggaggtgggagggagcgcacggcaacgcggaatccagcctaagtttggagggctgcgggtccggaagggcagcgcccaagtctccaggagcccgcgcggcctggaaagaggggaccggggagaggcaggcggcgcaggccggggcccgagggcgcccccaaggccgagccagggaccgggaatctgagcgccccgccaagcgactgggtctgaatgcaactgaaagcgccgagtcccc

SEQ ID NO: 321583 - DNA, 184 bp, Homo sapiens
atccaacaataggctgggagggctataacagctggtacagaagcaaaataaactggctgtccaaaaagtttcaggaaattcgcccaaaataaatctaaattgattaccaaaaatatcaagatatggccgggtgcaatggttcacacatgtaatcccagcactttgggaggccgaggcaggcgga

SEQ ID NO: 321584 - DNA, 391 bp, Homo sapiens
agcttggaaggccttcccaggaatgcaagtctgaaccatctagagttctctcagccagaatgaaggctcagctcttggatgtttctaccataaaaatgagaaagcatttcctacctcctcctctgtcactccacaaagatgtgcttcctgtgtggctggctagcagataagagaagaaccgtgtgctaactcctcatcaaagaccagaagtagatcctgaattgtattcattctcatctctttctacctcctccaagacagaaggacatgattaacttctttatctcaatgtcagccttcaatagctacaaaagtctaaactgtaaatagcgttgaagctttgcataataaaattcttttccccagtgatgggcagtttttcacatagtaa

SEQ ID NO: 321585 - DNA, 380 bp, Homo sapiens
  misc_feature (187)..(187): n is a, c, g, or t
cctggagtgaggaacacagggggctgtgggagcctaagaggcgcttgccccggcctctggttctagaaagacttccaggaggtggtgatccttaagccaagtacgaataggagccaactagaatgggaatgggtctggcagaatgaactgcaagcgccaaggcccagaggccaaaaaaaaaaaaaanaaaaatagaagcgcatgttttgattgaggaagcaagagcagcttagtatgcctagaacctaactggagacgggaaatggttctatagacgatgttagagttcaactatggctacattccagtcttcctgtaagtgactttgtcacattctggcttaaaactcccccaaagggatcccattaggaaaaaaaaaa

SEQ ID NO: 321586 - DNA, 334 bp, Homo sapiens
tcctgggcacaagcaatcctcccacctccccaggtgctggaattacaggtatgaaccaccacacccagccacaattttgctcctaaaacaaaccaagctgccagcaaaaagaattagcaggatcccaggctgacgcctttcaccatggccactgggagtgctcggtgggagcaggaaggctgacagccacgcctctgaggtcctcgagagtctcctctcatcaggagctgcatcaggagcagtttgaggaaacaaaaagctccagggtgggcattcctgcctccaatcctgactgccactgactggaagcaagatctgggacaatcccaacacc

SEQ ID NO: 321587 - DNA, 391 bp, Homo sapiens
tatcctcatcctatccacatcatactaacattgacttagtgcctaccgtggataacgcactgcactgagtacccaacaaaaactccattaatcttcactgcaaccctaagggaactatcatcattaattttctaattttacaaatgaactgagaaacagagaggttaagtaacttgtctaaggtcacacagccagcaagtggtagaactgagacttaaatccgggtagcctgacaacagaccttgggttcttcatgactgtagtacctgttccctcataattgggttaagagatgacaagcaaccccctgcagaacatgctcacagaaatagctctcccaagaaccagtagagtgcagtaggcagagcaggggactgctctaagatgaagg

SEQ ID NO: 321588 - DNA, 7989 bp, Homo sapiens
gaggatgcagagtgggagaccttaaaaccgtctgatctggctgctaaagcgagtgtctgacgaccacccattaacaccagcgagtagcgtttgctcacggctttaggataagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321589 - DNA, 699 bp, Homo sapiens
  misc_feature (645)..(645): n is a, c, g, or t
gtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagaagctggagtggtngcctgtttggattcaggcccaggggccgagacattcccttcttcactcttttcc

SEQ ID NO: 321590 - DNA, 1145 bp, Homo sapiens
  misc_feature (1070)..(1070): n is a, c, g, or t
  misc_feature (1073)..(1073): n is a, c, g, or t
  misc_feature (1076)..(1076): n is a, c, g, or t
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaagccggaagcccncanagngggaaccgggtataaaccggtggagacccggacacacaggggcgtcaagggggaagccacgggggactc

SEQ ID NO: 321591 - DNA, 7806 bp, Homo sapiens
tcgagcggccgccccgggcaggtcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321592 - DNA, 8015 bp, Homo sapiens
gggcacggccaggggctgcgcttcgccgcgggcgagctgatcacgctgctgcaggtcccggacggcggctggtgggaaggcgagaaggaggacgggctccgtggctggttcccggcgagctacgtgcagttgctggagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321593 - DNA, 8187 bp, Homo sapiens
gtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321594 - DNA, 8105 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321595 - DNA, 7289 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaaggatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321596 - DNA, 7849 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321597 - DNA, 7042 bp, Homo sapiens
tagaatgtgtgccgtagtattagagtttggtctgtaggtccctttcacctcaatttctggtgaacctgttacaattccttcattatagaagaaagcagccaccttacatttcaaaataaggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321598 - DNA, 7400 bp, Homo sapiens
tgtagacgtgtgtgggggcctcctgagctaaggtgacctgcctaagctgagacctgataggcagccacgtgtcagggggtgtctctcaccttcctgccaggtcgctaccccagactcatcctcacttgcctggggaagtgggggtgcccctcccatccctcctccctgcactggcttacagctgatgccctgggtcctgagtgtgcgtctctactctcccaacagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321599 - DNA, 7274 bp, Homo sapiens
  misc_feature (7268)..(7268): n is a, c, g, or t
tcgagcggccgccccgggcaggtcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagaagcaattcccattgcagcaggttagagcgagaatcagacagagggcaaaaaccaattcgcttctccccacgttctaaatgctngggcat

SEQ ID NO: 321600 - DNA, 5309 bp, Homo sapiens
  misc_feature (5292)..(5292): n is a, c, g, or t
tcgagcggccgccccgggcaggtcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgattcgcgaatggggtncgagccgaaatgtaatc

SEQ ID NO: 321601 - DNA, 1844 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacgggctctcgggagtcgtgggttccaggcagctgtgtggacccagggacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagttta

SEQ ID NO: 321602 - DNA, 528 bp, Homo sapiens
ctgagagctcagggccctgtccctgttcagagcccacagaagcacacagctcacccaagctgcccacttccccaggaagcaatgctctctctgaaggttcacctatggggatgggctcctgccctgggaacagaggctgacactttgtttaaagaaataaccagatttcagtctcttgggaatagtctcccaatgagttggtttctgcttccacctagtggtcaaagttagctaatacacaaagaggaagagaaggcctggtagaaccagtgaaaacctcggtaactagatctaagggaagccacgtttcactgcacgagaggacacgcatgttgcctctggaattagaatgtgtgccgtagtattagagtttggtctgtaggtccctttcacctcaatttctggtgaacctgttacaattccttcattatagaagaaagcagccaccttacatttcaaaataaggtaagatagaaataagtcaataaaaaataatgtaatagaaggataacgtttattatacaaatc

SEQ ID NO: 321603 - DNA, 1260 bp, Homo sapiens
  misc_feature (1206)..(1206): n is a, c, g, or t
gtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagtggtngcctgtttggattcaggcccaggggccgagacattcccttcttcactcttttcc

SEQ ID NO: 321604 - DNA, 2857 bp, Homo sapiens
tcgagcggccgccccgggcaggtcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaacca

SEQ ID NO: 321605 - DNA, 1454 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggtaagtgctgggcacccgcctggcctggtcagtgcacacagaaggagagggcacggggctaggagatgaggtgactggcgagggtgcatctctcctttgcaagactgcagcgaggaaattacttcccttgtttgccaggaggtaccccctcttcccttctctctgacccacacccagagatctca

SEQ ID NO: 321606 - DNA, 7733 bp, Homo sapiens
tcgagcggccgccccgggcaggtcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagttta

SEQ ID NO: 321607 - DNA, 8191 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtgggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttggtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaaacccatc

SEQ ID NO: 321608 - DNA, 2010 bp, Homo sapiens
gacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaaaaaaaaa

SEQ ID NO: 321609 - DNA, 491 bp, Homo sapiens
gccggtgaaccttgatgctgtggtcgtctagaggatcccgtgattattatacaagtaactcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaaaaaaaaa

SEQ ID NO: 321610 - DNA, 2386 bp, Homo sapiens
  misc_feature (2386)..(2386): n is a, c, g, or t
gacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaatcaaaaaaaagaaagtatgagtagaataaaaatattgggggggcgtgggccaaaaaaagttttaaaccccatctgttgggggcggcgcgggcccccgagtggatagccgggaacatgggggcccacaagggtggttccacgaagaagaaacaccgggccaagagcacaggggcgcgtggggctctcccccccaattaaaaaaaggcagcgcggcgggacaccgcaccgtgtgtttgggaaccaatcccagaaggcgggtttcaggaggacaagtacgggctctcacacaccaggggagtccaagcgacccgatataaaataccggcgcccgtcggacgagaaccacaccacacacaacacacacaaacaccaacaccacacgcaaccccacccacaacccacacacaagacaagaagcaccacacatgaagcgagaaccaacgactaggcacaagcgagactgaccagccaacagcacaagaagcgccagcaaaatcggtacaaactacgtccgcagaccaagcacgacacacaccggacgaacgaacagaaaactgaaagatcaacaactaccgaaagcaacacaggaaaccaagcgaaaccgacaccaaaacacacacaacaacagagcaacacaagaaaaaacactagaccaacaaccacaaaaacaacaaatcaaaaccagcagacaagaaaccn

SEQ ID NO: 321611 - DNA, 1906 bp, Homo sapiens
ttatcgggctcaccaaatacagctgcagtatgaattccatcttctacacaacagtaaaccagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtatagagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaaaaaaaaa

SEQ ID NO: 321612 - DNA, 2168 bp, Homo sapiens
gacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagactgaaaccacctgttttcagagcttcaggaaaagacttaatctgaaggatcctgcagctaaaaagctttgaaaactgtgttaaggggccccataagcatcgcttctaaacttcactgacaaaagggactggggtcatgctgtctggagtcagagtgagggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaaaaaaaaa

SEQ ID NO: 321613 - DNA, 1385 bp, Homo sapiens
gacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgccttcaggaggagaactccgttacacgtcacgaagtcaaatgccaggggaaaccattagctggaatccacaggaaaagaatgcaacacggagcacgaagcccaagcacagaagatcaaagacgccaggagaggacccctcgcaccttttccaaaccaaaaatgtgaagcagcagaacttccaaaacctccggcctcgtcttgtgattccaccaatgcagccatcgccaagcaagccttgaaatagcccatcaagggcaaacaggcccccgaaaaaaagctcaaggaaaagtcgcaaactcacggatttctaccctgtcccaaggagctccaggaagggcaaagcggagctgcaatttgaagaaagggaaagaatagatgaattggttgaaagcggaaaggaaagaaggagtgaagactgacctcatcaatgacaaaggccgggtgtgaacaccagagggagctctcccggggcgcctttgtggtagaaaagcaccggagcctcacggagatcaccgacgccacgggacccctccatggtggatctccgtggatctccacagttgaacgttttgtgcttcccatgcatgcagtcaaaaatgctgggattacaggcgtgaaccaccgcacccagctatgcaggacccattcttactgagtgagactcgggagtcatgacctggtgtctcctgcccaccctggtcccaggtaaatctgaatggaagcaggtatgagagcctgtcctcgcctttgattcccccaccccaccctgggcctcacaacggtgctacctaagaaagtctcttcccccagtcagcctggtgagtggtcagccgaagaggatctgacgggagtgtagatgtgagatagtatctttgttgtacctgtttgtggtttagctttgtatttaaacaaatgaggaaataaacttgaaaattatttgtcatcataaagttgaaacaaaaattattttaaaaaataaagttttattttaaaataa

SEQ ID NO: 321614 - DNA, 710 bp, Homo sapiens
accagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtataggtaatcggtcagagtggtgggagaaactgttgggaaaggagcaggccttctgaaaggtcggaaggcttcaggggagaataagctgaacgcagctgttctctgaccttgaggcagagggcaaggagtaggtacaaggacgtgtaggagaatttatcttaaataggcttgttcacttgtgttgtccagaaacgacttttgatcatcagcgcgcatgactgctccctgaaaggaagaacaataatgttaattacccgcagactgtgtttgctccaggctttcggcattatgtctgtactgaataaaagcaagcagctccagctgttcgaggctgctctcttcttcagccattagtgccgggcagcccactagctgctgttacactgcatatctgtgtctgagtactcctttcttcagttgcttggccagggtctgtgggacagacccagcagctggtgccctgtgtgaggaacgctgcaatggatcg

SEQ ID NO: 321615 - DNA, 1687 bp, Homo sapiens
gacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaa

SEQ ID NO: 321616 - DNA, 1674 bp, Homo sapiens
ccagtggcttgggagctggagcaggtggtggaggcctgaaatgactacttgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaaaaaaaaa

SEQ ID NO: 321617 - DNA, 1737 bp, Homo sapiens
agaagctggtggcaacttcactggggagatattgcaaataacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaaa

SEQ ID NO: 321618 - DNA, 1837 bp, Homo sapiens
tgcgtcacctgcaggcccgggccgcggggttggtttccaccctggaggttgctgacaccctgtgccctcggctgacttccagccggtggcacagacgcctccagggggcagcactcaagcgcatcttaggaatgacagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaaa

SEQ ID NO: 321619 - DNA, 1959 bp, Homo sapiens
tgcgtcacctgcaggcccgggccgcggggttggtttccaccctggaggttgctgacaccctgtgccctcggctgacttccagccggtggcacagacgcctccagggggcagcactcaagcgcatcttaggaatgacagagttgcgtccctctcggttgccaggctggagttcagtggcatgttcatagctcactgaagcctcaaattcctgggttcaagtgaccctcctacctcagccccatgaggacctgggactacagtaacagcgggaacatgaagccgccactcttggtgtttattgtgtgtctgctgtggttgaaagacagtcactgcgcacccacttggaaggacaaaactgctatcagtgaaaacctgaagagtttttctgaggtgggggagatagatgcagatgaagaggtgaagaaggctttgactggtattaagcaaatgaaaatcatgatggaaagaaaagagaaggaacacaccaatctaatgagcaccctgaagaaatgcagagaagaaaagcaggaggccctgaaacttctgaatgaagttcaagaacatctggaggaagaagaaaggctatgccgggagtctttggcagattcctggggtgaatgcaggtcttgcctggaaaataactgcatgagaatttatacaacctgccaacctagctggtcctctgtgaaaaataagattgaacggtttttcaggaagatatatcaatttctatttcctttccatgaagataatgaaaaagatctccccatcagtgaaaagctcattgaggaagatgcacaattgacccaaatggaggatgtgttcagccagttgactgtggatgtgaattctctctttaacaggagttttaacgtcttcagacagatgcagcaagagtttgaccagacttttcaatcacatttcatatcagatacagacctaactgagccttacttttttccagctttctctaaagagccgatgacaaaagcagatcttgagcaatgttgggacattcccaacttcttccagctgttttgtaatttcagtgtctctatttatgaaagtgtcagtgaaacaattactaagatgctgaaggcaatagaagatttaccaaaacaagacaaagctcctgaccacggaggcctgatttcaaagatgttacctgggcaggacagaggactgtgtggggaacttgaccagaatttgtcaagatgtttcaaatttcatgaaaaatgccaaaaatgtcaggctcacctatctgaagactgtcctgatgtacctgctctgcacacagaattagacgaggcgatcaggttggtcaatgtatccaatcagcagtatggccagattctccagatgacccggaagcacttggaggacaccgcctatctggtggagaagatgagagggcaatttggctgggtgtctgaactggcaaaccaggccccagaaacagagatcatctttaattcaatacaggtagttccaaggattcatgaaggaaatatttccaaacaagatgaaacaatgatgacagacttaagcattctgccttcctctaatttcacactcaagatccctcttgaagaaagtgctgagagttctaacttcattggctacgtagtggcaaaagctctacagcattttaaggaacattttaaaacctggtaagaagatctaatgcatcctatatccagtaagtagaattatctcttcatctgggacctggaaatcctgaaataaaaaaggataatgcaataaacacagttgcaggaaagtatgttagctatatactatgaagtactcttagtttacttatgttgaatggcttagctattaatactcaaattgagttaaaatgaaaattcctccttaaaaaatcaaacgtaatatgtattacatttcatggtacattagtagttctttgtatattgaataaatactaaatcacctaaa

SEQ ID NO: 321620 - DNA, 788 bp, Homo sapiens
gcacccttcatcagtttatttccagagttcttttgtccaagtataagaaaatacagaaatatatcctgattttgttttccatccctttttacccaaaaagatagcatagcctactgaatactctgttcttcactttgctctttttttcactaaatatatcttggagatcttcctgcatcactaacatggagagtatcctctgtcttttcatagccatatggttaaaatgaatgtgtagatgtacctccgtttacttaacctgaaccttctggatggacatattggttatttactgccctttgctgttacacacagtgctgcagtgaacaacttgatacatgattttgttttgcctgtgaacaagtccatatttaggagaaagtctcagaagtagaacagctggactggagcataaaaaagcacttgtaattttgagattgccagattgccctccataagaattataccagtttacttcccactggcaataattacaaatacttgttccctcatatccttgctaccagaatgttaaaatttgcatttatatcagtctgacagatgaaaaaatggtatttcagtatacagtcatccctcgtcatcagcggtgtgtggggcggcgggggcggttccagaacccttcccagatactagaatctgcagaaggttaagtcctgcagttggccctgtggaatctgtggattagacaagttggccctccctatctgcaggttccacatccttgaatactctgttttccatctgaagttggttgtagccatggatat

SEQ ID NO: 321621 - DNA, 1224 bp, Homo sapiens
acccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtgtcctctccctgctccacatttgtctcctttgtacctgggggaacagagaggaatgccctgacttttctttgactgtctggaaaatgggagtcaagtgtggggagtcattcacttcatt

SEQ ID NO: 321622 - DNA, 3345 bp, Homo sapiens
gcatgttgcggagtgattagtgggtttgaaaagggaaccgtgggctcggcctcatttcccgctctggttcaggcgcaggaggaagtgttttgctggaggatgatgacagaggtcaggcttcgctaatgggccagtgaggagcggtggaggcgaggccgggcgccgcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagctgggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtg

SEQ ID NO: 321623 - DNA, 2798 bp, Homo sapiens
gcatgttgcggagtgattagtgggtttgaaaagggaaccgtgggctcggcctcatttcccgctctggttcaggcgcaggaggaagtgttttgctggaggatgatgacagaggtcaggcttcgctaatgggccagtgaggagcggtggaggcgaggccgggcgccgcacacacacattaacacacttgagccatcaccaatcagcataggtgtgctggctgcagccacttccctcacccacactctttatctctcactctccagccgctgacagcccattttattgtcaatctctgtctccttcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321624 - DNA, 2741 bp, Homo sapiens
gcatgttgcggagtgattagtgggtttgaaaagggaaccgtgggctcggcctcatttcccgctctggttcaggcgcaggaggaagtgttttgctggaggatgatgacagaggtcaggcttcgctaatgggccagtgaggagcggtggaggcgaggccgggcgccgcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321625 - DNA, 2009 bp, Homo sapiens
caccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttgggggaagactttaactaggggcgcgcagatgtgtgaggccttttattgtgagagtggacagacatccgagatttcagagccccatattcgagccccgtggaatcccgcggcccccagccagagccagcatgcagaacaatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321626 - DNA, 1297 bp, Homo sapiens
cgaaccacacaggcttaaggagggtccccagcaccttatccatctgttttggaaacgccggtcgccccctggtgcttccggggctggtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagagactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321627 - DNA, 166 bp, Homo sapiens
tttgtaaacctataaatttgtattccatgtctgtttctcaaagggaatatctacatggctatttctttcatccacttctagggactcatttcccctggtgtgtcagttccagttcaagttcccggaagtgaacctgatatgtctcaatactggccaagattacagt

SEQ ID NO: 321628 - DNA, 2699 bp, Homo sapiens
gcatgttgcggagtgattagtgggtttgaaaagggaaccgtgggctcggcctcatttcccgctctggttcaggcgcaggaggaagtgttttgctggaggatgatgacagaggtcaggcttcgctaatgggccagtgaggagcggtggaggcgaggccgggcgccgcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321629 - DNA, 2602 bp, Homo sapiens
gcatgttgcggagtgattagtgggtttgaaaagggaaccgtgggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321630 - DNA, 2825 bp, Homo sapiens
acccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321631 - DNA, 1373 bp, Homo sapiens
ctaaagtgctttagaggcttgatacataggcagctttcttctagctgtggccagtggaaggactagctcgaggcccaatcttagatttatcatatggaattccagtacttcacgtgaaggcatctttaatgatcagacttgttggcagagttcctcgggaggagggagcctggggctgtggctgtgtgatgtgttcctcagtaaccacaggtttgcctctctcctcacagcccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagtttta

SEQ ID NO: 321632 - DNA, 429 bp, Homo sapiens
gagcctcttgcccttgcgcagagccactgtgagaggcggtgggagccaacacccttgggggagggggcagtactgctcggcacatcccagcagtactgccccctcccccaagggtggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321633 - DNA, 365 bp, Homo sapiens
  misc_feature (27)..(28): n is a, c, g, or t
  misc_feature (59)..(59): n is a, c, g, or t
  misc_feature (74)..(74): n is a, c, g, or t
aatgtgaattaagttcatatccacctnntgggaagcaggacaaaccccccccccccccncccagggtgacttcntccccaatccactgcaagtttccattttttaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321634 - DNA, 381 bp, Homo sapiens
ctgaagtaataagtagcatccaaagcgcagctgaaaattccattggtcagtttataccctaacagttgtagcttttgcaatggtaaaaactttaggctccagatattatcacctttgaaataatcgccttggatgattagttttccgttggagaaacttagtatatccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321635 - DNA, 376 bp, Homo sapiens
aattcccaattccccctccctaacccctggcaatcagtgttcaattttctgcccctatgaagttgactactctaggaacttcacataagaggaagcaaacagccaagcgaggtggctcatgcctgtaatcccagcactttgggaggctgaggtgggcggatcttctgaggtcaggagtttgagaccagcctgaccaacatggagaaacccagtctctactgaaaatacaaaattagccgggcatggtggtgcacgcctgtaatcccagctacttgggaggctgaggcaggagaatcgcttgaacccaggaggcggaggttgcggtgaccctccagcttgggcaacatgttatgaatgaaactccatctcaaaaaat

SEQ ID NO: 321636 - DNA, 5750 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321637 - DNA, 5716 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgatatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321638 - DNA, 5248 bp, Homo sapiens
caaagaagcgagcgcaaggagaaggccaaggacttgccaacattcaaagacaatgacttcctcaatgaagggcagaagctgcatgtgggagaggagagtaaaaagaacttcctggagaaactgaagcgggacgttgagatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321639 - DNA, 5715 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccacttggggagcgaaaaaacaccaccatgtgtgatttcataccagcattcatttaatgaattcaatccggtgtaagcgttaaagtgaacgtctgtgaacgttgttcagaatcacggaaaaatcagtggtaaaaaaacgttctggggacaaagacgactccacttagaagccatattaaaataaaataaaaccagaaatcctctc

SEQ ID NO: 321640 - DNA, 5094 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcaggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321641 - DNA, 2031 bp, Homo sapiens
atgcatttgcttttatttttttactctgatgccttttcaaattggcatgtcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321642 - DNA, 1592 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgatttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321643 - DNA, 1713 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321644 - DNA, 1565 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaaggtaaagggctctgtgtttgccggagctgtgcctcccctctatctgagccccgaaggggccactactccaacttccatgtaattgggaagctggagcctatgtgttggcatggacagggaactctggagtggatatgcctgattcttgtggaccaaaggcagtttgaagtccaggtgacagtaacaggagattatttaagccctaaatgtgccatatttatgcagcagttgatgttcctgtctgtggaatgtgcacagtgagggaggccgtgctgacgcatgcactttagcatccatcaggcccccatggactgccagcacaagtgcatctctagactctgagaaggacacacttgtggctgtgaactagggtgctccgtgttcttgaacctggcttctgacttctgtcaccttatgccgccatcccttcc

SEQ ID NO: 321645 - DNA, 452 bp, Homo sapiens
caaagaagcgagcgcaaggagaaggccaaggacttgccaacattcaaagacaatgacttcctcaatgaagggcagaagctgcatgtgggagaggagagtaaaaagaacttcctggagaaactgaagcgggacgttgagttgactactctaggaacttcacataagaggaagcaaacagccaagcgaggtggctcatgcctgtaatcccagcactttgggaggctgaggtgggcggatcttctgaggtcaggagtttgagaccagcctgaccaacatggagaaacccagtctctactgaaaatacaaaattagccgggcatggtggtgcacgcctgtaatcccagctacttgggaggctgaggcaggagaatcgcttgaacccaggaggcggaggttgcggtgaccctccagcttgggcaacatgttatgaatgaaactccatctcaaaaaat

SEQ ID NO: 321646 - DNA, 5391 bp, Homo sapiens
tccggtcttactttggctctccttgcaaagttatttctagttaatcattatgcagaaggtataggggttagtccttgctatagtgacgttcctcatcccgggatgaggaacgtcacccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321647 - DNA, 5117 bp, Homo sapiens
gagcctcttgcccttgcgcagagccactgtgagaggcggtgggagccaacacccttgggggagggggcagtactgctcggcacatcccagcatcaggtcagatcattgaaattaaaaaatgtgatttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321648 - DNA, 5210 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaattttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcgcagagccactgtgagaggcggtgggagccaacacccttgggggagggggcagtactgctcggcacatcccagcatcaggtcagatcactgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321649 - DNA, 3260 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgagttcttggcacagctgaagatcatggactacagcctgctggtgggcatccacgacgtggaccgggcagagcaggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagttcccccaagaaggaggtgtatttcatggccatcattgatatcctcacgccatacgatacaaagaagaaagctgcacatgctgccaaaacggtgaaacacggggcaggggccgagatctcgactgtgaaccctgagcagtactccaaacgcttcaacgagtttatgtccaacatcctgacgtagttctcttctaccttcagccagacccagagagctggatatggggtcggggatcgggacttagggagaagggtgtatttgggctagatgggagggtgggagcagagtcgggtttgggagggctttagcaatgagactgcagcctgtgacaccgaaagagactttagctgaagaggagggggatgtgctgtgtgtgcacctgctcacaggatgtaaccccaccttctgcttacccttgattttttctccccatttgacacccaggttaaaaaggggttccctttttggtaccttgtaaccttttaagataccttggggctagagatgacttcgtgggtttatttgggttttgtttctgaaatttcattgctccaggtttgctatttataatcatatttcatcagcctacccaccctccccatctttgctgagctctcagttcccttcaattaaagagatacccggtagacccagcacaagggtccttccagaaccaagtgctatggatgccagattggagaggtcagacacctcgccctgctgcatttgctcttgtctggattaactttgtaatttatggagtattgtgcacaacttcctccacctttcccttggattcaagtgaaaactgttgcattattcctccatcctgtctggaatacaccaggtcaacaccagagatctcagatcagaatcagagatctcagaggggaataagttcatcctcatgggatggtgaggggcaggaaagcggctgggctcttggacacctggttctcagagaaccctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggtttggagggagccacaggaaaccaatctattcattcaaaatggtttcacaagcgatcttcacatctttggggttatctacaagtctgaccatatctcatc

SEQ ID NO: 321650 - DNA, 2171 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgcctgaccgtggatggtgtggaaacctacatggtggttaccaggaacgtgttcagccatcggctcactgtgcatcgcaagtatgacctcaagggttctacggttgccagagaagcgagcgacaaggagaaggccaaggacttgccaacattcaaagacaatgacttcctcaatgaagggcagaagctgcatgtgggagaggagagtaaaaagaacttcctggagaaactgaagcgggacgttgaggtacttactaaccttcattttcacctgcaaggctccttctgtacctagagtaggcgcctcttaaaccttaagaagaatggaattcagtactttccaggagtatggacaaaagggtggtgatttgagcagcgtgggcacttatgggcacctaaagcaagtgcaaatgatcattccacctgacggagcatagttggcgccagtaggacctttgtaatttagtttagaatgcttttcccttttcactaattcattccaacacctttttcaaactcccttctgctgttgtccctacaatggagagggcatctggccatcagagctgtaggaacccagctattaaggtcctgtaaccccaacattttgggaggctgaggtgggaggatcgcttgagctcagcagttcaataccagcctaggcaacatagcaagacctcatctctactaaaaattaaaaaatttagccaggcgtaggggcacacacctgtagtcccagctacttgggaggctgaggcgaaaggattgtttgagcccgggagatgaggctgcagtgagctgtggtctcaccactacactccagcctgggcaacagagcaagacattgtctcaaaacaaaaaccgaaaaagttggctaagcatggtggcttactcttgtaatcccagcaccttggaagggtgaggcaggaggatcactggagcctggcagatcaaggcaacatgagctgtgatcatgccactgtgctccagcctgggtgacagagcaagaccctgtctcaaaaaacaaaaatccactaatcaggttcttctctggctctggctctgattctccacttacctagcaaacttctgtttgtaatctggggaggacaggtgctaaatagtgaaaa

SEQ ID NO: 321651 - DNA, 1281 bp, Homo sapiens
ttgcgggaaagagccaaaccctggcgttggggggcccgggcggggagcccctcccgcggtccacagcgacgcctgcccagccctcctccccttccggctccggcacggggccccgaggcgttcggaggccaggcgggtttctgtcaggcccggggaggaggggcgggcggggcggccgctgcctccccgggacgggccgtaccacgcggacggggaggacggggccaggggactgcagggcggctgcaccgcccgggggcggggtgcggagcgggccggcgggctccccggggcggggcgggagggcggggcgtggggcggacggaaccaccggggcggggtgggaggtaacgggacgggcgcgaccatggcgcggtgagggagcgggggtggggatcggtccgggggaggcctgaggccgctggcttgtgcgctgtctccgccgcccccctctttcgccgccgccgccgccgccccgggcatgtcgtccaactgcaccagcaccacggcggtggcggtggcgccgctcagcgccagcaagaccaagaccaagaagaagcatttcgtgtgccagaaagtgaagctattccgggccagcgagccgatcctcagcgtcctgatgtggggggtgaaccacacgatcaatgagctgagcaatgttcctgttcctgtcatgctaatgccagatgacttcaaagcctacagcaagatcaaggtggacaatcatctcttcaataaggagaacctgcccagccgctttaagtttaaggagtattgccccatggtgttccgaaaccttcgggagaggtttggaattgatgatcaggattaccagaattcagtgacgcgcagcgcccccatcaacagtgacagccagggtcggtgtggcacgcgtttcctcaccacctacgaccggcgctttgtcatcaagactgtgtccagcgaggacgtggcggagatgcacaacatcttaaagaaataccaccagtttatagtggagtgtcatggcaacacgcttttgccacagttcctgggcatgtaccgccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgcatgttacgatgaatctccaacctgaggaaaaaaataaaactcaaaaagctttgtgtaaaaaaaaaaagtgtgagtc

SEQ ID NO: 321652 - DNA, 5119 bp, Homo sapiens
gctggcggagagcggcctgcgggcgatcgggccgagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgaggcctattccgtggaggggacccatccgagaccctgcagggggagctaattctcaagtcggccatgagcgagatcgagggcatccagagcctgatctgcaggcggctgggcagcgccaacggccaggcggaagacggaggcagctccacaggcccgcccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccggccccccagctccctcgccactgccggccacaccactcagcgccaaggaggacgccagcaaagaagacgtcatcttcttctaaaagggccgtgactcaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgaaaaaa

SEQ ID NO: 321653 - DNA, 5179 bp, Homo sapiens
agcaccaactctgtccttgcctctgtcacagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgagccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccggccccccagctccctcgccactgccggccacaccactcagcgccaaggaggacgccagcaaagaagacgtcatcttcttctaaaagggccgtgactcaaggtgcaaggcccctccctgccctgcccacccttcctgctctctggggacccccatggggtcaccatgcccacccagctgtcccctcctcttccctagcaaaccactgatgaccgcctggcaggggccagcctgtcggtgctctgggccttgcagctgtttctgtagggttagcggtggtgccggggtcactttctgaatctctttttttttttttcaaaaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgaaaaaa

SEQ ID NO: 321654 - DNA, 4563 bp, Homo sapiens
tccttgtaatccaagcagtcgtatgtcatccagaaaatcggcgactcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgagccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccggccccccagctccctcgccactgccggccacaccactcagcgccaaggaggacgccagcaaagaagacgtcatcttcttctaaaagggccgtgactcaaggtgcaaggcccctccctgccctgcccacccttcctgctctctggggacccccatggggtcaccatgcccacccagctgtcccctcctcttccctagcaaaccactgatgaccgcctggcaggggccagcctgtcggtgctctgggccttgcagctgtttctgtagggttagcggtggtgccggggtcactttctgaatctctttttttttttttcaaaaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgaaaaaa

SEQ ID NO: 321655 - DNA, 5045 bp, Homo sapiens
agcaccaactctgtccttgcctctgtcacagcctcgctcaaggagcacccccggggcaccctcctgtccgatggcagcccggccctgtccaggaatgtcggtatgacggtctctcagaaagggggtccccagccaacaccgagcccggctggccctgggacgcaactcggaccaatcacaggagagatggatgaagccgattctgcgtttttaaaatttaagcagacagctgatgactctctgtcccttacatctccaaacaccgagtccatttttgtagaagatccctacaccgcctcgctgaggagtgagattgagtcagacggccacgagtttgaagctgagtcctggagcctcgccgtggatgcagcctacgccaagaagcaaaagagggaggtggtgaaaagacaagatgtcctttatgagctgatgcagacagaggtgcaccacgtgcggacgctcaagatcatgctgaaggtgtactccagggccctgcaggaggagctgcagttcagcagcaaggccattggccgcctcttcccatgcgctgacgacctgctggagacgcacagccacttcctcgctcggctcaaggagcgccgccaggagtccctggaggagggcagtgaccggaattatgtcatccagaaaatcggcgacctcctggttcagcagttttcaggtgaaaatggggagagaatgaaagaaaagtacggtgtgttttgtagtggccacaatgaagctgttagtcattacaagttgctgcttcagcaaaacaagaaatttcaaaacttgatcaagaaaattggcaacttctccatcgtgcggcggcttggcgtgcaggagtgcattctcctggttacacaacgcataaccaaatacccagtgctggtggagcgcatcatccagaacacggaagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaagatatcctggctatcctgctgaccgacgtacttttgctgctacaagaaaaagatcagaaatacgtctttgcttctgtggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagagctgccctgacgaggaggaggggcccttcagcctgcccgaagaggaaaggaaggtggtcgaggcccgcgccacgagactccgggactttcaagagcggttgagcatgaaagaccagctgatcgcacagagcctcctagagaaacagcagatctacctggagatggccgagatgggcggcctcgaagacctgccccagccccgagccaggagggctgagaccttcgcgggctacgactgcacaaacagccccaccaagaatggcagtttcaagaagaaagtcagcagcactgaccccaggccccgagactggcgaggccccccaaacagcccggacttgaagctcagtgacagtgacattcctgggagctctgaggaatcgccgcaggtggtggaggcgccaggcacggaatccgatccccgtctgcccaccgtcctggagtcggagcttgtccagcggatccagacactgtcccagctgctcctgaaccttcaggcggtaatcgcccaccaggacagctatgtggagacgcagcgggctgccatccaggagcgggagaagcagttccggctgcagtcgacgcgtgggaacctgctgctggagcaggagcggcaacgcaacttcgagaagcagcgggaggagcgcgcggccctggagaagctgcagagccagctgcggcacgagcagcagcgctgggagcgcgagcgccagtggcagcaccaggagctggagcgtgcgggcgcgcggctgcaggagcgcgagggcgaggcgcggcagctacgcgagcggctggagcaggagcgggccgagctggagcgccagcgccaggcctaccagcacgacctggagcggctgcgcgaggcccagcgtgccgtggagcgcgagcgggagcgcctggagctgctgcgccgcctcaagaagcagaacaccgcgccaggcgcgctgccgcccgacacactggccgaggcccagcccccaagccaccctcccagcttcaacggggaagggctggagggccctcgtgtgagcatgctgccatccggcgtggggccagagtacgcagagcgccccgaggtggctcgccgggacagcgcccccaccgagaaccggctggccaagagcgatgtgcccatccagctgctcagcgccaccaaccagttccagaggcaggcggccgtgcagcagcagatccccaccaagctggcggcctccaccaagggtggcaaggacaagggcggcaagagcaggggctctcagcgctgggagagctcagcgtccttcgacctgaagcagcagctgctgctcaacaagctcatggggaaagatgagagcacctcacggaaccgccgctcgctgagccctatcctgcccggcagacacagtcctgcgcccccaccagaccctggcttccccgccccgagcccaccgccagctgacagcccctccgagggcttctctctcaaggccgggggcacagccctcctgcccggccccccagctccctcgccactgccggccacaccactcagcgccaaggaggacgccagcaaagaagacgtcatcttcttctaaaagggccgtgactcaaggtgcaaggcccctccctgccctgcccacccttcctgctctctggggacccccatggggtcaccatgcccacccagctgtcccctcctcttccctagcaaaccactgatgaccgcctggcaggggccagcctgtcggtgctctgggccttgcagctgtttctgtagggttagcggtggtgccggggtcactttctgaatctctttttttttttttcaaaaaggaaagtttttaatggaaagttgagccagaactaaaccagggagctgtctgaaatcatagcaccccatccgggtggcggggagatcaactccgagctgtttttccgaggcagtgaggaacggtgccgcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctggctgatcgtccttgttcccagtggggtacatgtgagcccctgccagggccaagtccttctcccgaacccagggtcctgggaactgcagatcccggggggattcagcccttctcccactgtgctggcagaggcactcctgtgacgctgaatacagtgaacagggacattcccgccactcggggacagatgggcacaagggaggggaaactccatcaggaagtgctcccctgggcagaggcgcccactgggtgctgtgggctcaggagggggcggggcaggagctggtgccaaccgggaaccagagccccacagccatacagcccattggtgacaaggtcctgagaacacagtggccaggtgtccccaggctcctggcccctccgacgacctcaactctgcccagcccggtccctggccatcagcgacgctgtccgccccccgtcagatcccatgtgtgccatgtttatcatcagtgttttgtatttttgtactgagtatcggagcactttacagaagctgactgtacattcctgttctgttgtgaagagaacattcccagaccctggcaccctcctgagccggcgtgtgccggtccagccctccgagatgccacaattccttggatgggggagaagttcaaggaatttctgctcggccacgcggtgggaaccccgcgtccccgccatgtggcagaggggtctcagtcgtgctaggcatcgggcggcagcgccgacagcccttccctcgccagtgcccctcggccactcctgggttggagcccgattttatttgtaaagttgacagtcgagcaaatgttcctattttcgtgggatctgcacacgtctttgtcagttgtggtcatgatcttagtcacctgctaattatttttacaatgattacaacatttcctcactgcgggatatttctgacccgctttagaacttaagacctgattctagcaataaacgtgtccgagatgaaaaaa

SEQ ID NO: 321656 - DNA, 390 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtaagatctgtaacactgaggaagtaccaataaagagctgctaacact

SEQ ID NO: 321657 - DNA, 1060 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcagactggaaatctcaaaaacacacgttcagcaccaagattttcagcagcaccgcctcagaatgagacccctagaaaaaactgcgtgttttccacttgcccaacacgaggagtttttggaacacgacctgcttgaggtggagattttctagatgggcaaagagaaggaaacacttaacctaggaagagtatttaggaagaagaaagaacacagcctttctgcacaggaaaccgccgagcagaggggcatctggcctctgcagtggcctccaaatagagtccaatggctggggccagcgtggctgcttaaaggggactcaagggatataataaaatgcagattctcaggtcctagtgcagacaggctcacccaataagtctggactgcatatgggaatctctatttctaggcccttctgcaaggtattcctgctctttccaggaaccatcggcagctggtttggggaaagaagcaacgactccaagtgtgacctgtgagctg

SEQ ID NO: 321658 - DNA, 9822 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaacctggacaccctcactcctcaccctgacaccctcactcctcaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321659 - DNA, 8958 bp, Homo sapiens
ggtcggccctatccgtgttcggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaacctggacaccctcactcctcaccctgacaccctcactcctcaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321660 - DNA, 9780 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321661 - DNA, 9746 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcactgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321662 - DNA, 9817 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgtaaaaagaaataaaagttagcagaaagaaataaaagtta

SEQ ID NO: 321663 - DNA, 10168 bp, Homo sapiens
  misc_feature (9818)..(9818): n is a, c, g, or t
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgtaataaaacaaaaaacaaaaacaaaaaaaaaaaacacatngtgttggggccgacattagggcccccgagaaaaacgttgctatacaacccatccggtgggggcgcagggggcgcccccaggtaaggggttaccgagacaaccgtgggacacagaaagcaggcgggcgccaagaggagaagaccacggcggcacaagcaacagacggcggcggtggggagcttcccccacacaaatagaaaaaaacggccccggggggggggacacccagaacggtccgcagaagacaaaaaacccccagacagggggagctccagagggggccaacaaggggagcttaacacaaacagcgggaggactacaaagaaaggacccgagaattccaatagtac

SEQ ID NO: 321664 - DNA, 9643 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccacttgatcattacaggaagcttcagaaaccgtgggaccagtgtagaagaatggagtatctgtccaaactaagaataaaaagaatgacacttgta

SEQ ID NO: 321665 - DNA, 9200 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagaccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321666 - DNA, 8203 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaattttgtatttttagtagagacggggtttctccatgttggtcaggctagtctcgaactcccgacctcaggtgatctgcctgccttggccccaaagtgctgcgattacaggtgtgagccaccaaaactggaccgaattccatttttgcaa

SEQ ID NO: 321667 - DNA, 5903 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321668 - DNA, 4725 bp, Homo sapiens
ggccatgagccgcagggaagcttccacttttgtggtcattaatgcaagagtggatgcaaatgttagagttatgagtgcactggagatctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321669 - DNA, 4369 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggcacaaaggaagggcactacaaccacaaccaatatcagtaaagctttggaagacctctgctacctatttaaaataatcaacactcagccagaagagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcagcgcctctgctgctgctgtgcacagccggccgcttcaataaaagttgctaacaccactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaacctggacaccctcactcctcaccctgacaccctcactcctcaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321670 - DNA, 6711 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagaggtaatgtaatgctgtagatgggaataggagcattgatcttgctcttcttcctgactgtagtacttcctttctatggctttaaccagccacctcctcctgggaaacatctcctgtgggcttgttgggtatagaagctactctaagacccaaccagataccatgatgccactgttaattctgtttgctcttctaattaacctaagctagtgtgtatgtggacagggagggtggacaaaattctacagtaaatatttcaaaaattatagcatcatagaatcatctttatggctgccagatttgtcatcaacacccccaggatagacagtttcatcttccgacctatctggaaaatctcaggaccatgtccccagacctcctaactaaccatagcaccccaaaatacccaaacccctattgtgaagtggaactcttccccacttagtggatcccccctggaccctgctgtccccctgccctgaccactattatcggaatctgggaagttgggcatctatatctccagtgcactcataactctaacatttgcatccactcttgcattaatgacacaaaagtggaagcttccctgcgatgctctggtccaactctagttgccaagtttccaagaccacggggaggtaaatgagattccatttgtgagtgaaaagaccatatatggtaccttctcccggatgggaacatacaaaggaaaaacaactgcctgatctgggaaggtgacagtactaccttcttctagaaaacaaagattgttcaaccaccaccatgagaacaggtggaaaatatctctatagacccaacctggcaatgaagtataaacatcgcaccccgcagggcttctcttggtgccctagttgggttcatttttgtttgtgactatgaatgggaagaagtcacaccctgtaaccactccaactccctaaggagtcacctcttctttaaggaatagctttcccttgtatctaaaaaacttggaactgacatgaatgaacgttggccactcttacccctccaggggtcacaatctataacgcctaggacccaagaatatcagaaataagtaagcaataaaactaattctggcaggaatcagggtggcaataggactagcagcaccctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcagactggaaatctcaaaaacacacgttcagcaccaagattttcagcagcaccgcctcagaatgagacccctagaaaaaactgcgtgttttccacttgcccaacacgaggagtttttggaacacgacctgcttgaggtggagattttctagatgggcaaagagaaggaaacacttaacctaggaagagtatttaggaagaagaaagaacacagcctttctgcacaggaaaccgccgagcagaggggcatctggcctctgcagtggcctccaaatagagtccaatggctggggccagcgtggctgcttaaaggggactcaagggatataataaaatgcagattctcaggtcctagtgcagacaggctcacccaataagtctggactgcatatgggaatctctatttctaggcccttctgcaaggtattcctgctctttccaggaaccatcggcagctggtttggggaaagaagcaacgactccaagtgtgacctgtgagctg

SEQ ID NO: 321671 - DNA, 2886 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgccgaccgaggactgaccactcgacccggttctgggttgacaatatccagacggaggagatctctgaagtgaagaggatgcaagaatgacgtct

SEQ ID NO: 321672 - DNA, 483 bp, Homo sapiens
gtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgtatattttgtatgtctttttcactttgcctttctagtaattcatttttcttgatatttacaccttgtggccctgtgatagactggaaatctcaaaaacacacgttcagcaccaagattttcagcagcaccgcctcagaatgagacccctagaaaaaactgcgtgttttccacttgcccaacacgaggagtttttggaacacgacctgcttgaggtggagattttctagatgggcaaagagaaggaaacacttaacct

SEQ ID NO: 321673 - DNA, 3338 bp, Homo sapiens
  misc_feature (18)..(18): n is a, c, g, or t
tgctatgttgctaggctngatcttgaactcctaacctcaagcaatcctcccacctcggccttccaaagtgctgggattataggcatggagctgccacacccagccaatgtgccgaagaaagaaagaaaaacatgctcatcctttgagtcaggttcgaattttttctcctctttaacccccagtcactccagttataagtgatttttaactcttctcacactttaatgcaactggcttgcccttgagttccttcctgggcaaagctaagaaccctcccgggctatgcttcaatcttagggctcgcctgtcctgcatcactgggatcatctcccagtaaactagccacacttacatccatgtgtcagggacatttctggagaaagcagcccaggacactgttgaataaaacacacaatagtctctgtggtcttctccaccccaccccacaccaggcaccctcagcttgattctcctttttaattgcctgtaagcagggaagcacaatgttttcacattctttgtaaggcctttgttctactaaaatctaacctcagagcacaattttaaactagatgaaagagttgctgcgcctgaagcactgcaaacacctcctcaccacacatgtgcactcaccctggacaccctcactcaccctgacaccctcactcctcaccctggacaccctcactcaccccagacaccgtcactcctcaccctggacacctcactctgcaccctggacaccctcactcaccctggacacgttcactcaccctgacaccctcactcaccctggacaccctcactcaccctggataccctcactcctcaccctggacaccctcactcaccctggataccctcactcctcaccctggacactctcactcaccctgacaccctcaatcctcaccctggactccctcactcctcaccctggactccctcactcctcaccctggacaccctcactcctcatcctggacaccctcactcaacctggacaccctcactcctcaccctgacaccctcactcctcaccctggacaccctcactcctcaccctgacaccctcactcctcaccctggcaccctcagtcaccctgacaccctcactcctcaccctgacaccctcaagtcttcacctccctggctgcagcctgggacacgctttccctaacttctgaaggctcagtcctcctcaagccaatctcatctcaaattgcacctcctcagagaggtcttccataaccgcccttataaagcaggattctttcaccaataccccttcccacatggcactgtctcacagcactcctctaaaagtctgtttacttccttgacaatctgtcttccttataaggggaggttctgtaaaagccaagactctctctgtctagttgactgttgcataccagggcttagaccaaggccctgacatgcagtaggtgcttaatatgttttgaggcaaggtcttgctctgttgcacatgctggagtgcagtggcacaatcgtaattcattgcagccttgaactcctgagctcaagtgatcctcctgcctcagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctccctttgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaacaagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgta

SEQ ID NO: 321674 - DNA, 5135 bp, Homo sapiens
tgctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaattggcagagaggcaagacagcagagacagagaggcagcaattggtgagagacaagagacagcagttggcaagacagcaagagacggtgaagcagtctgtgattgaggatgtggtgaaactgagtggacagccaagtgtccatagtacagctgcctcgtgtgggacccactgctctaacgagccagcccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgttgtgttgactctgggataccagagtcacgttgtcacgttgttctatgttctgtaacctggtcttgggttcacggggttggccgcccactgggtaccccagggtttttggcactgctgtgcacagctgctttggcgagggcatccttgttggctgaaacgcaggcattttgggttctcagcatcggtattataggccaccctccagatgctctggggtttttagcactgacatttcctctaggattgtgggttatacccctttcgctaggcgaatattggtcttgtctttttccaccctgaagttaggagtattattttcctaatagccaattgcaagctccttcctgtgtactgtcttataactcccttgcctaagctgctcttggtcaaaggaattgggagctcccaggctcctggcctggcagtcagccacctacagtggtagacaagtggccagcccaatatttttttcagtatctccactactgggtaggttcttcagcaagtcagagcctctgaggtctccccttgggcaacgctgtttacccctttcccttcctccatttgtttagccccctctccacccaactctagatctctatggaatttaggctccacattcgactgcccattcgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagacgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatatcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctccttgcccctcaggattactcatcttgagaaaatgttacaaaattagcatctgggatgcctagacaagacttgatgcctgacttgctgacccctgggccagaatcactgcgcctactatacgcaaaagggcccctggcaatgcaaatgtcctaactgctctggtgagagagaacaataacaacaaaaagcttccatcaatactagagctaaccttctcctactagccccagtgagctgcttagctcaagtaagtttactgtcccagaggacagctttccacagtggcagataagcagccgcctgaacatttttctttggtatttccaccactgagtgtgctctccagtggcgtggggactccagaatctccttttgagcaatgcagtttgcttcctcccctttttagttgatgctatgggattccctgtcctgccttttcctgttttccatacctatcggggcaaacaaaatttggccaggtagatgggtcccagttctgtaaataacttgaatccagttgtcttgtataggtcattttatttaatatgtttttgggtatatgtacatgtattgtgatgtgtgttacatctagcgtgctgtcaaactggcttatagataaaagaacactcatacattcaacaaataagactactgaaagcttattagtttgaagagaatcttgtatcttctaaaatttaactttaggatttttacctaggtaagtcactgatgttcataggctttaaaatggttaaaatggctttaaatggtgaccagctttgcatggtaccttggttctcggtgatctagataaagttaaaagtgaaataattaaatacacgtaaatgggatatgcttaatgtgtggtttaaaatcataaaatggtagaatggttctcagctatagaatgacaatgtctagtgtgaagttcatgacttcttccttcctaggtttccataaaatgtgctaaagaaatgtattctttattgagaaaaaattttttgtctaatccggaagttactaaatgggaggttcaaaacatgagtgaaccagtgagtagaaaagagagatgtaaagaatattatgaatagaaaatgtattttttgtttgttttgcaaggaaggatataaagaaagagtaattttatatgtggaggaatcctgtatagtaaattccctatcctagagtaaaataactttaagaaagaggtagtatagaacatgtcaggaaattcagctatgttgtagatggtctgtgtaagtcatctgcacagtgcatgagtgtggaggtgggcgggcactcattggcccttgaactccttttgagcagtatggaagccaagaactagaagccaggaaatggggttgtaaaactgatttgtctatggattttatgtgttgagctgctgtggtcttggcttgtagtaattacctatatgaaccttcccccctcccctttagaatttaggacaggttcaaaaggccctccaatataaaaataaaatactgtccttccccacaaaggaaaaaatagctccccggttcaaccaggagacttagtcttgctaaaaccttaaagacagggtaaagacagggataccccaagaatcaattacaatgaaatggaaggggccttatcaggtattgttaagtacccccactgctgttaaacttcagggaacacctacttgggcacacagatccaggactaaacctgtttcttatgagtcacaggcacaaaggaagggcactacaaccacaaccaatatcagtaaagctttggaagacctctgctacctatttaaaataatcaacactcagccagaagagattaccacagttccagagacaatgctggcacaaggcttccagcccatcctgtccactgacacggagaatgaaatcgtcctgcctctgggctccttagatcagactggaaatctcaaaaacacacgttcagcaccaagattttcagcagcaccgcctcagaatgagacccctagaaaaaactgcgtgttttccacttgcccaacacgaggagtttttggaacacgacctgcttgaggtggagattttctagatgggcaaagagaaggaaacacttaacctaggaagagtatttaggaagaagaaagaacacagcctttctgcacaggaaaccgccgagcagaggggcatctggcctctgcagtggcctccaaatagagtccaatggctggggccagcgtggctgcttaaaggggactcaagggatataataaaatgcagattctcaggtcctagtgcagacaggctcacccaataagtctggactgcatatgggaatctctatttctaggcccttctgcaaggtattcctgctctttccaggaaccatcggcagctggtttggggaaagaagcaacgactccaagtgtgacctgtgagctg

SEQ ID NO: 321675 - DNA, 901 bp, Homo sapiens
ttttttttaccacttcgctaatacttttattttctgtccatattcaagcgtgttgagattatctagtttcctaaagtaacaaatataatatatccactccaccacacatttcagcatttaatactcttgtttttccttatgtactagtgacatccttaatacagaaatcatcaatagaaaaatgcagtgtggacattcaacagagcaggaataaaacaacaggtaattgtgtggcttcaatttcctaagaataactgttaatatttggtagatttcatgtgttaccttaggcacaattcataacaatccatatgttaagatattcttatcattctgcttttctggattagaaaattgagacataaaaagattcaacaacttggctgagggtcacataagcaccaagtgatgaggctgggaattatatgtaagtggtctgacttatgagcctaaggttttaaccagcaaggcatgctgcctcatgaggagcctctgctaggatactccactgttgataggaaatatgtgaaatatctgattattttagtgagctgttaagtttggtctgaagttaattgatagaacttaaacatagaatgaattctttactatttattatatttcctcaccatgcagccacattagtcttgttccagtgtgtgttaataaaaaaaggtgactactgttgagtgactatagtggaatatgatctgtgtgcacattctcacagaatggaagttttaagaaaacctgaaagtccttctggaaaattctatccaatagatcacattaagtaggtaaatacatcgtttagcaattggaaattttcttataattttttctccatggtatttcttattaatttagtgaaaataattatttgctatgcattttgtgcatc

SEQ ID NO: 321676 - DNA, 722 bp, Homo sapiens
agtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactctt

SEQ ID NO: 321677 - DNA, 815 bp, Homo sapiens
agtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttgactatgaatcccatctcaatttatttgcttcccattactgatctctgtacttgtagctgcacatactattggtactacctaatagtgccaca

SEQ ID NO: 321678 - DNA, 2302 bp, Homo sapiens
ggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagctatcatctctccatattgtatttgttcagctggtttaattcactcaggtggatgattgcacatacattggaattggctggagagactacacagagaagtttaatgatcgtgtacaatttgagggttgatggtagggctttctaaaaaaagtaatatcaagtgtgttgttagtattcatttagtcatttttattactaatctataaatatatttattaaatttgaagattaaatggaattataaaggaaaata

SEQ ID NO: 321679 - DNA, 379 bp, Homo sapiens
atcacttgaggtcaggagttccagaccagcctgtccaatgtgatgaaaccctgtctttactaaaaatacaaaaattagccgggtgtggtggcgggcacctgtaatcccagctattcgggaggctgaggcaggagaatcgcttgaacccaggaggcggaggttgcagtgggctgagattgtgccactgcactctagcctgagcaacagagcgagactccgtttcaaaaaataaagaaatatcccatattgtcattacttgattatagctttatgcattttttagcaaaatacttctcatttctcatgtgcatacctcataactgtttagagttgctgtcataagagtatattgtatttctgcctctaaaaatttacttgg

SEQ ID NO: 321680 - DNA, 5736 bp, Homo sapiens
agatcataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctccggtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttgaaataaatttcta

SEQ ID NO: 321681 - DNA, 985 bp, Homo sapiens
gcacgagcaaaaaaaaaaaataataataataataatatctaattaaatagctttatatgaatagagactgaatattttatgaatagtagatgataaaataagaaacataaatttgatttggcctatggattatatacttacctggtagaataaaaccatgcagatttatcgcctagaattccagacctataatagtactaagcataagttaatttcattcctttctgtagccatcatcaccatgtaaccaatatcatcttatatgcactgtacatgcgagatgaaatattttacttgccttccaacacagccctaaagccctgcaaaaattttcaggttgtgaaacctgaagctgatctggaataagtacgttggttaaggtaacagagcactaagtggttgtaatgggataagcttagatgggcagtactgtgaaccccatgctcttgctattatgatacattgattgtctttcttactgtagttcttaatgaaccttgggagaccttgaatcaggatggccaaagatctttccaacctgtgccagtggttcacaggagcctttgggtatcgaatgtccatgtcatctcttggccttgctttcttagctttgcagttcagaggtgatcccgttctcaatactaatattagcttataccccaatctatggaacctttgcttatgggtcccaatcacagtgaaattcttataactcctcacatgtaactcctcacatgacgccaatgtgcagacagggttggcaagcggtattctagctgattctgtcacacagctatgactgtgtgagagtgaagacccagatcttcatgtatcctgaagttaagatttatccaatcctgtctaccaaactggaaattacaaactgaagaaaattgtcactttgaagtatcttttctttttttcagaatcagaaatgttacaaaagaatataaaggaaagcctgataaaatagaagccttgaaag

SEQ ID NO: 321682 - DNA, 252 bp, Homo sapiens
agcggccgctcgcgatctagaactagactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttgaaataaatttcta

SEQ ID NO: 321683 - DNA, 5036 bp, Homo sapiens
gcacgagcaaaaaaaaaaaataataataataataatatctaattaaatagctttatatgaatagagactgaatattttatgaatagtagatgataaaataagaaacataaatttgatttggcctatggattatatacttacctggtagaataaaaccatgcagatttatcgcctagaattccagacctataatagtactaagcataagttaatttcattcctttctgtagccatcatcaccatgtaaccaatatcatcttatatgcactgtacatgcgagatgaaatattttacttgccttccaacacagccctaaagccctgcaaaaattttcaggttgtgaaacctgaagctgatctggaataagtacgttggttaaggtaacagagcactaagtggttgtaatgggataagcttagatgggcagtactgtgaaccccatgctcttgctattatgatacattgattgtctttcttactgtagttcttaatgaaccttgggagaccttgaatcaggatggccaaagatctttccaacctgtgccagtggttcacaggagcctttgggtatcgaatgtccatgtcatctcttggccttgctttcttagctttgcagttcagaggtgatcccgttctcaatactaatattagcttataccccaatctatggaacctttgcttatgggtcccaatcacagtgaaattcttataactcctcacatgtaactcctcacatgacgccaatgtgcagacagggttggcaagcggtattctagctgattctgtcacacagctatgactgtgtgagagtgaagacccagatcttcatgtatcctgaagttaagatttatccaatcctgtctaccaaactggaaattacaaactgaagaaaattgtcactttgaagtatcttttctttttttcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctccggtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttgaaataaatttcta

SEQ ID NO: 321684 - DNA, 2657 bp, Homo sapiens
acagcgcgaatacccagggtagatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctccggtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttgaaataaatttcta

SEQ ID NO: 321685 - DNA, 1422 bp, Homo sapiens
agatcataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagctctgctggtcactccagtggggtcaacatttcaagaatgttacaagcagctgggcttggtggctcatgcctataatcccagcactttaaaaggctgaagtagaaggagcaca

SEQ ID NO: 321686 - DNA, 428 bp, Homo sapiens
aagtcaaatagttaaagcaaattctagatacatggtagagaccaggagaaaatatgaataactttcttctaaacaaggagctcagtggataaaccatacctctagattccttgcttccattttcccagaagtaagttcactgtattttttctgttttgttttgtattttgcttttgtgtgtgagtttgtttcagaggttttgtcttttcttattcctatcacaaaattataaataaacctttataaactgaatgacaatcatctatgcagaaattattttgaaaaatattgggctactttaaagattttatatctggtaattaatattagataaataaaaacattgagttagaatgttttttaaaaaattatgcaaacattatgttgttttaaacataactgagtgtagaaataagtttaaattggct

SEQ ID NO: 321687 - DNA, 1482 bp, Homo sapiens
  misc_feature (1481)..(1481): n is a, c, g, or t
agatcataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggtgagtcaaacgcagcacaaataaataaacggaggaactcaggaaaactgggaatcttcaatgcatctttttttttttgaaatggagtctcgctctgtcgcccaggctggagtgcagtggcgtgatctcagctcactgcaagctccgcctcacaggttcacgccattctcctgcctcggcctcccaagtagctgggactacaggtgccggccaccatgcctggataattttttgtattttctgtagagacggggtttcaccgtgttagccaggatggtctcgatctcctgacctcgtgatccacccacctcggcctcccaaagtgctgggattacaggcgcgagccaccacgcccggcctcttcaatgcgtctttattaaaacctgtttctccacaaccaaggggtacaaatgagagatacctacacagaataatttcagatcatgaacaaatttccacttagttaatttcagtggggagaaatgctctgcagtgatggnc

SEQ ID NO: 321688 - DNA, 4580 bp, Homo sapiens
agatcataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctccggtgaagaccttgtcagagggaataaagagaaagctgtgctttgtcctgagcatactggggaacccgtcagtggtgcttctggatgagccgtcgaccgggatggaccccgaggggcagcagcaaatgtggtgaggaacattaccacggtcagggacagcacggatgacttgcatggagcctgtgaaccatttttcttctgtaaaaattgtcccttaaactcttttgtggagaacaaaaaaactatcaatgtcacttgtaaaaccaatactttgca

SEQ ID NO: 321689 - DNA, 2784 bp, Homo sapiens
ggcgacgctggcgtccccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaaagaggtggggggattacttgaggtcagggtttgagatcagcctgaccaacattggtgaaaccctatctctacttaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcacaaaaaaaaaaaaaaaaaaaagaaaaaaaaaaaaaaaaaaaaaaaaaaaaaaaaaaaaaaaaaaaaaaaaaaaaaaagggggggggggcaaaaaactctcggggggcacgacacagcctaggcacgcacccgccgttcgtcgacaacaaaaggcggcgccaaaagcagggaccgaaaaataaaacgcaagcgacggcgggggcgccgaacaaccacacgccgcggaggaggcaaacagcgagacgggcgctgccctagcagaagacgcccacccggtggggggaaactactgcggggacaaccacacaaaggaagacagcgcgcccgaggaacaccaacactcgcagggcagcctgaaccacgccgaactcgaccgcagcggaagagcgccagcggacgagtcacgaaaac

SEQ ID NO: 321690 - DNA, 2318 bp, Homo sapiens
ggcgacgctggcgtccccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaataggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaaagaggtggggggattacttgaggtcagggtttgagatcagcctgaccaacattggtgaaaccctatctctacttaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcaca

SEQ ID NO: 321691 - DNA, 2691 bp, Homo sapiens
ggcgacgctggcgtccccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaagtacgtggcaaagctgggattcagacccaggcctacctggctccatctcagaggccttcgttcctggacttcttggaatcctcggaacctatttccacttgtccaccaaagcaaaacttcagatacttggtgtctgaggcagtgtcagtagtggctggagaacatgaactctgtatcaactgtgtgaccttgggcaagtccgtgctcctctgtgagcctcagtgtctctgcctgtaaaatgggataatgacagcaacatcagaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaaagaggtggggggattacttgaggtcagggtttgagatcagcctgaccaacattggtgaaaccctatctctacttaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcaca

SEQ ID NO: 321692 - DNA, 2375 bp, Homo sapiens
ggcgacgctggcgtccccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaaagaggtggggggattacttgaggtcagggtttgagatcagcctgaccaacattggtgaaaccctatctctacttaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcaca

SEQ ID NO: 321693 - DNA, 2714 bp, Homo sapiens
ggcgacgctggcgtccccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgatgaggaagctgagactcagaggggttgaaggactcgcttaaggtcacaagcaagtacgtggcaaagctgggattcagacccaggcctacctggctccatctcagaggccttcgttcctggacttcttggaatcctcggaacctatttccacttgtccaccaaagcaaaacttcagatacttggtgtctgaggcagtgtcagtagtggctggagaacatgaactctgtatcaactgtgtgaccttgggcaagtccgtgctcctctgtgagcctcagtgtctctgcctgtaaaatgggataatgacagcaacatcaggtttgccaccaggatcatataagaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccaggcagcactgtacgcagcaccctataagtctgacttcctgaaagcgctctccaaggggcagaatgttacggaggaggagtgcctggagaagatccgcctcttcctagtcaactacacggcgaccatcgatgtcatctacgagatgtacacccagatgaacgctgagcttaactacaaggtgtaggcatgcccactgctggacacgtccccgactcgtggccacatggagaaacaggcaaaccagaatcactgtgaatcaagtcggtgaactgcccctggcctgtgtcccccagagcagcccagggtcctgccagagtctgcaggggacagccctcgttttttaagtcttttttttttttttttttggtctattctaaaggaccagtaaataatgatcttacttccaaatctccttggaatttcacgacagcacagactgactttataccttcatttcagcgtggtaaaaaccgattaacacttctaatgagtcaagtcctagggttttttggttttgttttgttgccaacgaggaacacagctctgggggaatggtgtcatccacctcgctttaaaaataagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgaggcaggagaatcgcttgaacccgggaggtggaggttgcagtgagctgagatcgcaccattgcactccagcctgggcaacaagagcgaaactctgtctcaaaaaaaaaaaaaaagaggtggggggattacttgaggtcagggtttgagatcagcctgaccaacattggtgaaaccctatctctacttaaaaatatagaattagccaggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcaca

SEQ ID NO: 321694 - DNA, 1000 bp, Homo sapiens
ggcgacgctggcgtccccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcaaagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggagcgggacgagaaccaccccaacctcatccgtgtcaacgccaccaaggcctacgagatggccctcaagaagtaccatggctggatcgtgcagaagatcttccagttgttggagatggattctcgctctgtctcccaggctggagtgcagtggcacgatcttggcttactacaacctccgcctcctgagttccagtgattctcctgcctcagcctcctgagtagctgggactacaggcatgcgccaccaagcccaggacctccatggactcccagttgcccacccagggaccccagcttggaagtcctgaatcagcctgccttccttgggaccgaggcctagacactcccatccctgcctgtgccatcaccttcatatggaggctatctttgaagtgcccgtggccagctgtgactggccctacccacaggccaccacgcccagctgcccagaggaatggaatcacagccagtggctgggcagctgagagtagctgtgcccatggcaacggtcatctgagatgagctt

SEQ ID NO: 321695 - DNA, 629 bp, Homo sapiens
gcgcatcactaggatgttacacaaattcttttttgtttgaaaaatgttccagagataaaagtgcaaaagaagataatgaagtgttctaatatgaaatattcaaaactgaagcatgattgtctgcttaagacacttcccaagtatacaggattaatatttcttttctcacagctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaa

SEQ ID NO: 321696 - DNA, 700 bp, Homo sapiens
agccgcgggctgagcgcggatccgcggcgggcgcaggatacgggccggggcgcgagccgagcgcagtctgccgggccgagcgggcggagcgagccgagtggggctgagcgcgccggcggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctctgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccaggtgagttgcgtttgtaacatttgcttccagtaggaaatgggttttgccatgacttttgctgtgtcaattgggatctatatttttgtcaataaaagtattatataatagt

SEQ ID NO: 321697 - DNA, 376 bp, Homo sapiens
tggatctttctgcgggttgtacctggttctaggaagcacacctgtgcttttggtaggcagtgaactctgaacccttctttggctacctgtggaactcagtggtggcagatgcaagtctgattgactctctctgagctttattccacgctgtgactgtttcagagaaaacatgccgagccatttcaagtttaaggaatactgcccgatggtcttccgtaacctgcgggagaggtttggaattgatgatcaagatttccaggtgagttgcgtttgtaacatttgcttccagtaggaaatgggttttgccatgacttttgctgtgtcaattgggatctatatttttgtcaataaaagtattatataatagtaattttca

SEQ ID NO: 321698 - DNA, 272 bp, Homo sapiens
ggggtgggggcggtgaaaggggcaaacttcagtgtccagggttggaaggtgtatgtggtttttttaggttttcttcaagcgcctttgtcattgtttttctcatttgttttaggccaaagaactgccaactctgaaagataatgatttcattaatgagggccaaaagatttatattgatgacaacaacaagaaggtcttcctggaaaaactaaaaaaggatgttgaggtaagaacagtcagtggagaggccagactcattgtataaatatcag

SEQ ID NO: 321699 - DNA, 1851 bp, Homo sapiens
agccgcgggctgagcgcggatccgcggcgggcgcaggatacgggccggggcgcgagccgagcgcagtctgccgggccgagcgggcggagcgagccgagtggggctgagcgcgccggcggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctctgtcctggcgagcaagaccaagaccaagaagaagcacttcgtagcgcagaaagtgaagctgtttcgggccagcgacccgctgctcagcgtcctcatgtggggggtaaaccactcgatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaa

SEQ ID NO: 321700 - DNA, 2498 bp, Homo sapiens
  misc_feature (984)..(984): n is a, c, g, or t
  misc_feature (1254)..(1254): n is a, c, g, or t
  misc_feature (1720)..(1720): n is a, c, g, or t
acatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagagtgagtgcagcgacaccggcggcgcccctgctctcctcgcggcccttccccgcacggttccagccctcttctctccctgcttctcggcctcagggctctcactagctgccggcgtccaggcctcggcggggagctctttacttacactggccatttccctcttctccccactccctcttcccccagcccaaggacgcggcgtctccagccccggtatgggtggtggaggggtgggtggcagcgctggagcgtgggaaagctaaggtgagacaggtctgtgaatccggggtctctgtcacttggggaaaaaaaacgggcagaaaanctctgaagtttgaaacacataaggaaaatctgctatctgtacccccaccctcccaaaatatagttgacgccccgcgtgatgaagagtttatgggggtggaggcttggaggagatgtcactgcgcctgggagcttgtgtccgattccgggaggtggccgtgtccgagtgcgtggttgtacatttccgaaggtctcagtttctctcactttcagcccgcgagttcctccgcttctcctttagcaggtagtaaaatgctgcgctttcggtaantgccagtactatttccctcagcccttggggagggggaaacttattccaactgtctaatataacattttggtaatccgctttggtgattaagcttgcgtttgactgatcagctatttcaggaaccgactgagttaggttgacgacccagagtggaatcgggaaaggagaggtggaggattttattgcccttcccccagctccatggccacttttccactgactattaataaccatcttatgaatggtaagataagtaacgttttcccttctatctactacctcagctgtacgaaacgggaaaactaggagacatttagaatagaattcaaggttattaatgaaccagggagtgcaaaagtgcacgcaaaacctggtggctggcacacctgcgccttttcctttaaccccatcccctcggtagttttggccctcccctatccgtgcacggcctcgctggttgattggntcgtccgggaaccaatcagctcttccaatgcctgggcgccttgatgctgaccctgttctggtggcccggataccccggggcaggcttggttcccgaccctaagggttccggtgggagagactgcttggaatctgctctgcttattatctctaattctcctttccttctcccatcatcctataaagcgtttctccatgggctgaaatggaaaacgtgtataaatggggctagacgattggagtgtgaaagtgaggaggcagaaatgcgctttgatgggagctcagacagtaaaaattaacacatcataaaagatgagcacggaagagaacgttgtgggtggcgaaggtacaaaatagcattgtaacttccaagagaaagccaaagcaaaaataaacacctgtgtaaggaaagacctaaaggagaaaaaagagcctgccaaacataccaaacactatttcttgactgaaataaaaacgttatttaaaagcccatttaggccgggcgcggtggttcacgcctgtaatcgcagcactttgggaggccgaggcgggcggatcacgtgaggtcaggagttcgagaccagcctgaataacatggagaaaccctgtctctactaaaaatacaaaaattagccgggcgtggtggcgcatgcctgtaatcccagctactcgggaggctgaggcgggagaatcgcttgaacccgggaggcagagatggcagtgagccaagatcgcgccattgcactccagcctgggcaacaagagcgaaactccttctc

SEQ ID NO: 321701 - DNA, 6471 bp, Homo sapiens
acatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgtttgttcccaagttgcattttctaaccgaatcagtgtgttttcatgaaactgagtgtttctgtggaccagtagttcctctgttgtcttcagtggtcttcctgtgtggctcaagggttctctgtgagagtctggattttcatttctggaatggctggccccatcccacttttctgtatcatggggacacatataaagcagtgtttaatagagcagtttaagaagttgcttgcatctgttggttcaccatggctcatctggggaccattttggattcatgtttcatggcttgtgactgtccccaagcccactccaaacaaagtgtaaggatcagagttctgtcaaggagcagcagttctgctctccccatcatctttgtgcaaggcccctcggggggcactttaataaaagaatttgaaatgggttgactggccattctcatgctgtgctccctgtctcttctcttctctaaagaatcatgtcccagctcctcaaggtccctctatggttccacatctgagtgttcgccacaagagcagcagcagcaggcacagtgcatgccatatctacctgctgcttctctgctgggaggaatggccaagtagattataaaactcacttctgtctcttaggcagacttgtacggccacaaaattacctagtcttcttcctgctgagctactgaggtattgccaccattttgacaactttgagtaattaaaacactcttctgacccaaaaaggaaaaaaggtcactgacgtgacccccccagcatgctagagagctaattccagttctcatatttgtttgaatttcttcccagaggagaggataggaacctctcctccagggcagtaaatcacctgcatttctggagttgtcggtattgtattcgaaaaggcctggagcccctcctgctcaggaaagaactcattccagggtgtggagacagtgccgtctggcaggtgaaatactgtgggaattcacgccaccaggtgtttgtgcaagtgttggcctgggaagaatgggacttcggccttgtcaggagttgtcttcatctgcagcacgtttcttcctcctgcagtagatcttagctaccccagatatctctatggagagaagtttgtggaaaatgctttgcttcgtggcagagtctgatgctgtaggaaaaccttcgggcatgtgacagcagtgtggtccactccctgttctgccctggcgctcagagtcatgtgtaagtaggaaacctgagcaagtcttccgtggaggaccctgagctgccgtctttgggatccttcctgtgtccccaccgtctttcatttatttgctttcctgggcctctatctgggccctaccttgagcttctccagttttattcaagccaccagagtaagaatttgggtgtagatgtcacaactaccttctactcaattcaccaattcatttactgctatggcacgtctcaggaataactctagaaacctctaaatcgaaatattataaaatcttgagcacttagtcctgctggttttagttagaaaggcatccaggaattgttttcctacgcccccttgagtggaaagatcttagttagaagataaagtcaagtttgtgttcaggggatgggaggaagactataaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgtgtctacataacgggttggcccctggtgcatccctggaaaagtcaaaggacgcacacttcgaaattctgcagaacgtatttatacatggttcagaaatcttgcgtatctgacttatagccaaatctgcttgctcgaatagcctcagaggaagtcttgtttaataaaaaccttttgatttcctagtcaagtctttatggttgtctcgaggggtgtgtggctactttaatgaaaggctttcctgctctaaatctctttgctgggctgggcctcttcagactatctggtgaaactcctttccttagaacaaactcagtccgtccatgctctgtggcattttgctagatgataaccaaagccttattcctgtagccagtgtcagcagtcagagaggtggagggtgtgttctgctgtggttatgcatacctatctgctgttcttgaggtgtaaaaggaaaggtgaaaatcgggccaggccaagtactcagctgtcttaataggatgaagccttaagcagtggaaatttcagttattttccacagtattccattttggaggatttggggtgtttactttttaaattcttgaacaacttaacctccatgaggctttgtgaagtcagctgtgaccaccctcctcttactgtgttctcagtattcattcacttccagggaagaatgacagccacagggagatggtggtgggcaagaatgagagtcccaggatccagatttagcctcagatcttccccattcaggaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagcaaaaaaaat

SEQ ID NO: 321702 - DNA, 1055 bp, Homo sapiens
  misc_feature (25)..(25): n is a, c, g, or t
atcagctcgcccagatttaccgganactctcacagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagcaaaaaaaat

SEQ ID NO: 321703 - DNA, 1934 bp, Homo sapiens
acatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtttgtgcatttctacaattgtagggttgttcctcaagcattcttcccaggacaagctggaatggcaacaccgcacgggacccctagggagttgcggccgccgggcccggaagggtgtgggga

SEQ ID NO: 321704 - DNA, 780 bp, Homo sapiens
caggtaatgcaagaaaggtttcaagtgagtgcattaaatagaatgtctcgttactcctagacaaatacatgtagagcagctactaagaatcctgaattggttttatctcccccacagactgagacctcctctgaagcagaaaaatcagatatttaactttgcatttatagcacttggcacagggtaggcccttaataaatgtttgctgaatgaatacgcaaaggaagacagcaaacaagctcactgctgatcttctggctagcataaaatccacttataaatcatcattctgactatacctcagacattacattttcaattaatttcttctatgtcaattactaagcccaccgcttaggctcattcacaaatgtgtattaggccccatgtgtctatatagcaagtctccaagggagactatccctggccacacagctcgctgtataatcaagtaccctacaatgcatatctgaaaaccactaggctgggcaggaaaagggaaggggaatcagaagtcagtttgttagggagaataatatgcttccaatttcttaagtggtagtattcttgttttttttcaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtttgtgcatttctacaattgtagggttgttcctcaagcattcttcc

SEQ ID NO: 321705 - DNA, 1903 bp, Homo sapiens
acatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggacacagaacttccttagcagggtgttggaaagtcccaggcctgttctgtggaaggggaataaaaaacagattcaaggaatgtcaaaaacacg

SEQ ID NO: 321706 - DNA, 2388 bp, Homo sapiens
acatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattccccaggccggaccgagctgat

SEQ ID NO: 321707 - DNA, 4566 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321708 - DNA, 3392 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321709 - DNA, 4453 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgatattttttattctgattagccattttaaaccaacgaggaataaaaagaaatcctgatctaaccagcgcaaaaaaacttgt

SEQ ID NO: 321710 - DNA, 1523 bp, Homo sapiens
tagtagtacataggagagattgggaatcaggcttattttaagcagggcaataaaggggaatgtttgggtaagaaagtatggatatagaaaagaacatcatttttttctctgaacctttgaaactgtctccctttccaatgttttctgtcccatttcctgacacctacgtcttgtctcttctttccagagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321711 - DNA, 1756 bp, Homo sapiens
tagtagtacataggagagattgggaatcaggcttattttaagcagggcaataaaggggaatgtttgggtaagaaagtatggatatagaaaagaacatcatttttttctctgaacctttgaaactgtctccctttccaatgttttctgtcccatttcctgacacctacgtcttgtctcttctttccagagatgaagtacagctgaagaccacctacagcaaatccaacgggcagcccaagagcttaggctcagcctcccctggcccaggccagccacctctcgcaatggaagcctatcttatgacagcttgctcacaccttcagacagccctgattttgagtcagtgcaggcagggctgagccagacccacctttaggctatacctctcccttcctgtcagccaggctggccagcaacgggaagctgagaggcaccacgtttggtgccaactggcccaacacaccgagagccctcaccagtccgttacgacaatctgtcgcgccacattgtggatagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321712 - DNA, 2515 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaaggtactgagtactctaagaggtggggtaataacatgccaactggccaggcacagtggctcattcctgtaatcccagcactttgggagcccaaggtgggtggatcacaaggtcaagagattgagaccgtcctggccaacatggtgaa

SEQ ID NO: 321713 - DNA, 1925 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacataattctaataaccaaagaacccacaaccaataaaccaattacgaataaattcca

SEQ ID NO: 321714 - DNA, 1503 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcgagattgagaccatcctggctaacatggtgaaaccccgtctctactaaaaatacaaaaaaattagccaggcatggtggcaggtgcctgtagtcccagctactcgggaggctgagccaggagaatggcatgaacccaggaagcggagcttgcagttagccgagatcatgccactgcactccagcctg

SEQ ID NO: 321715 - DNA, 546 bp, Homo sapiens
gcaaccatgaggtagacctaggatttgaactaaggaccctgactgtagattccctgctcttaaccataacatatataaatttcttgtgttttactcatttgcatagccctcagatagtgagtgcacaataacttgtaatagatttgtattttggcctttggaagtcaaggtctcatcttctaacctggtattttttttctccctctaggttacgggtaaattccggggaggtgtgaaccccttcaccaatggctgctgtaacaatgtcagccgtgttctctgcagttctccagcacccaggtacacctatccctctggtctagtgtttaccattggtcagaacttttatcttctttgggcttgttctggtaaaggaggggtctggtgagagcctttaggaagggttctctatcttagaatgttaagtacccactctatcttagaatggtaagtagtctatcttagaatggtaagtacctacatgcccatcctttagtgcagtggtccctaacctttttggcagcagggaccggtttcatgggagac

SEQ ID NO: 321716 - DNA, 4444 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321717 - DNA, 4512 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttccaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321718 - DNA, 2666 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggcgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321719 - DNA, 3549 bp, Homo sapiens
gcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcctggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagcgcaaaaaaacttgt

SEQ ID NO: 321720 - DNA, 345 bp, Homo sapiens
gtgctcacttgaacccatgaggcagaggttgcagtgagctgagatcgtgccaccacactccagcctgggcgacagagcaagactctgtctcaaaaaaacaaaagcaaaaacaaaaaacaataaaatggctgtagtaaattcttccctataaataattactttaaatgtaaattgattaaaccccctaatcaaaagatatagaatggctgagtggataaaaaaacaagactacatgctgtctataagaaactcactttagatttaaggacacacatagagcaatgtgtgtccttaaacatattccatgcaactggtaaacgagtgcagaagtggttatacttggat

SEQ ID NO: 321721 - DNA, 2720 bp, Homo sapiens
gcctctggattttgcgtataagcacacgtggggaaggaattgtttgttagtgagagcgccgattattcttgtaagaatggggatggcaagatattttcacttcgagtatcagacctttttaaagagaattgtgaatcgttcaattagggtcccgcggggtacaactgggggttcaaagcccgcggaagataccaggcagccttttttgggaaccccgaagttgtggcataattctacgaggggtcacgagaggatttgaagagccattcctgtgcataaacaattggtgtaaaccccgttgtttatgcgaaaaaatgtccccagattataccgcgggcgtgcatggcggggcgcccttcatggttcccacgctatccctcgggaaggctgaaggcacggagagaagtttaacctgaattccgcgcgagagttggaagtcttgccacaggtatgccccaggagttgtgccccctgcaactcccaccctgggccaacaggggccagaagatccgctttccaaaaaaataaaaaaaaaaaaaaaattgaagctgcaggtaactccgtgtgcttatgcagctactttagaaactgaaatgttcccactccttagatagattcttacatttggctctaatagcacacacaggatgtgactttggagaagaaggaagatctcttgccatttggcacagctttggagaaccaatgtttctgggagatcttgattttattaacatttggagacctacaagtttaaagagctacagaaacctttatactctttgcttgagagacatgaggatgcaacttaaaaatgttataatttaaatgttagaaattgactagagatgtataccaatgaaaaggaaaatgcttagttaagcatgatcattgtttacatgtgttataggaacttaagtttaaaatttatatttatctttcttacaacctaagagcaaataatgctttaaagagagattttaaaagttagtatgagttaatatgggagggcaaggaataacagggatatgtaaagccccttcagctacatgtacagaggccaactacaagagacatcattgaggaaatctgggaaaagtaagtgtccatgtctagggtgatggaatgtctgagtgagagaagaggacccttaagttgaacaggttcagagtgagattgcttccagtttctgctcagggatgtagagagccagaaacagcatcaccccagacttaacaacagaaaaatctagatgaaaggcaagttcaagacctttcttgacttcagagtgctgaggttacagagcagccagcaggcctaaaatctaaggagagaaacatatttgcagggaggagcaagatgcagcactggattccagtgcaccgacagcctgagtcaagtaacttgcaaaagacagaccctctcgaaggcacaatgccaaggaaagaccaaaagctgaaagtggagcagatactgagaaaaaacaaaaaaattacccaccaaaccagccaccagctgaggcaagaagtataactagaggaatttgaaagctgttgtacatgctgtagaaccattacaatactcaaacctggcctaaaaaatagattaattcagaggtctaaaagaaggaaaggcatgcccagtctctgtgtcctacacaagttacacagttctcaacaagaaattatgtagcatatgatgggcaagaagggaaaaaagaaacctcccaagagacaaaaccatcatcagaacaagactcagagaggacacagaagttggaactatctgacagggaaagtaaaataattatgaatgatgtattaaaggctagtggacaaagtgggcaccatgcaggaccgggtgggtaatcacagcgtagagatgggcatgaaagaaaccctcaaatggaaatgtaacatctgtaacatcaatgccagagatgaggaacgcatttgatagcactcaacacagcctggaaaagaatcattattcaagctgaaacagagaaagaagaatgaagcaaacagaatagagcattctaagaatttggagacagcctcaaactgtccaacataggtgtaattggaatctcagaagaaatagttgaagaaataacagtcaggaattttctactgagccaaagaccatcaagtaagttaaatacagaacaaaaacaaaacaaaacacttgggcatatcatattcaaactgatggaaaaaagaaaatcttgaaagcagagaaaaaagacagattacatacagagaaacatatttggcagggaggagcaagatgcagcactggattccaggtgcaccgacagcctgagtcaagtaacttgcaaaagacagaccctctcgaaggcacaatgccgaggaaagaccaaaagctgaaagtggagcagatactgagaaaaaacaaaaaattaccacaaacaggcaccagctgaggcaagaagtataactagaggaaatggaagctgtgtacatgctgtagaaccctgacatactcaactgggctagaaatgataattcgaggtctaagaggcaggtgccagtccgtgcacagttaccggctcccaaaaattgggcattagggcaagggaaaacaccccaaaaacctcaaatccaagacaatggctggcgccaacatacggtacggcagcccccgggcacaaacagattccaaggcccgaatcggaaattccgcgcatacaataggcg

SEQ ID NO: 321722 - DNA, 7442 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321723 - DNA, 6830 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321724 - DNA, 7299 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321725 - DNA, 6928 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatgtgagtgattgtccccatccctgaattgccttctaagtctcctggagggaggactcctctggtgcctctggctgtcctgacaactacttcccaaccagactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321726 - DNA, 6886 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321727 - DNA, 5438 bp, Homo sapiens
tgtttttttgttgtggtttgtgtttttttttttttttttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321728 - DNA, 6297 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321729 - DNA, 5786 bp, Homo sapiens
tttcggtgcttccctcttcccccgttcgctggtctactgattgtgcgtcgcctgcatctcgcgtcctgcgggcgtttattgcgtggacgcgcctgcccgtcatgtgttttcgttgtcgctgtcgatggttcggtgcggtgctttatgtctgatgcgatctctggggctgtgcttcccctctctcactggtttgtgttttcttaagatgctgggttctgtttggcgtgtcccgtcgccaaactattatgatcttcgtgcgtctctctagctctttcgctcgcgtttgcggccttggtgttgggttgtttggtgtggtgttgggttgttgttgttttgtgtgtgtgtttaggtgttcggtgggtgtagtgttggtgactttttttttttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321730 - DNA, 5494 bp, Homo sapiens
tgtttttttgttgtggtttgtgtttttttttttttttttttttttttttttttttttttttttttttttttttttttttttttttttttttttttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321731 - DNA, 4333 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321732 - DNA, 6598 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321733 - DNA, 6347 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321734 - DNA, 5225 bp, Homo sapiens
agggggaggaagatgataggctaggtacgaggctgggtgttgagggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatgaaaaaaaaaagaaaagaaaagaaaatgtcttactttgggccctgttgcactctcccgtgctgttttagccccagccctactctattcccagtggcctttgccttcattccttctttgctctgctgggcatcttgagaggaaaacttcacaccgacttcctctactataaattctctccctcctctcaactctacacttctctttgccaacatacaccatactgcttcactgatttttttttttaagcccacagtcctttctggctcttttccacctttaacactcttatgttgaaatcttccgtttttcctcctttctctttagtaagacctcaggtttttaaaaaagctaggcttgattgtttattctgcatggtccacttctgccttccttcctcttctattacccttttcttattctagactg

SEQ ID NO: 321735 - DNA, 1892 bp, Homo sapiens
  misc_feature (1856)..(1856): n is a, c, g, or t
  misc_feature (1858)..(1858): n is a, c, g, or t
  misc_feature (1863)..(1863): n is a, c, g, or t
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggtgagcttggaagtagcacttgctgtagncnccagngtgctgatacgggaaccgagctggaattt

SEQ ID NO: 321736 - DNA, 4523 bp, Homo sapiens
  misc_feature (4518)..(4518): n is a, c, g, or t
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtggtggctcacgcctgtaatcccggcactttgggaggccgaggcaggcggatcacttaactcaggagttcaagaccagcctgagcaatgttacgaaatcccgtctctattaaaaaaatacaataaccagccagacgtggtggtgcgtgcctgcaatcncagct

SEQ ID NO: 321737 - DNA, 3050 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggcttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcaagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgcc

SEQ ID NO: 321738 - DNA, 1871 bp, Homo sapiens
ccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacgtgtcacagcagcccacgccaacaggatgcagacaggtgcaatggaaacagtccttgcggagccaagactcacccagggtaaaatatttcccctcatagtgacagggggggcttggaagtagcactgctgtgacaaagtgatggggaccggc

SEQ ID NO: 321739 - DNA, 1295 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtg

SEQ ID NO: 321740 - DNA, 919 bp, Homo sapiens
tgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagt

SEQ ID NO: 321741 - DNA, 1332 bp, Homo sapiens
tcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggaggggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321742 - DNA, 1204 bp, Homo sapiens
  misc_feature (928)..(928): n is a, c, g, or t
  misc_feature (930)..(931): n is a, c, g, or t
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcatccacanannttaaattccgctcccgtgggccacttggggggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321743 - DNA, 1142 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatgctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321744 - DNA, 1143 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321745 - DNA, 903 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcaatcagtgaagtggagcccaaatactatgcagatgaggtgcacctcatctgctcctgcactacccccgcccccaaaataacggctccaacaattaattaatcttcttcatcttggcgtaaatgggacaaccctctattccaatcaaaaacttaagaaacaatcttaatttgtccctttaaactcatatccaaagccttaatcaagccttatcaatcctacctccaagatgggttcccaaatatctgtgctcagtctcatttctggacatctgctactgttcccttatgctgagaagcttctggattactcttaggttggtacccgattcaggttgggcaata

SEQ ID NO: 321746 - DNA, 657 bp, Homo sapiens
gccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321747 - DNA, 676 bp, Homo sapiens
cagctggggtcttagggggctgtagtgcatgtccactctacaaatggcaggggggctggaggtggctgtgcctacactgagctcctttgcagcctctcctttctccctctccactccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321748 - DNA, 622 bp, Homo sapiens
tcggccgcctactactactaaattcgcgggcgcgtcgacgcctcagctcgtcggccatctgagtgaggtcccgcttcatggctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321749 - DNA, 1188 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321750 - DNA, 1066 bp, Homo sapiens
  misc_feature (1042)..(1042): n is a, c, g, or t
  misc_feature (1066)..(1066): n is a, c, g, or t
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaacaaacataaacaacactaacaacatacacaacaccgggcctcttcttcggggagacacgatatacgacgcgcgaatatctcaccctttcaagnacacgccgccaagtgtatacgacn

SEQ ID NO: 321751 - DNA, 538 bp, Homo sapiens
tcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggaggggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccaggg

SEQ ID NO: 321752 - DNA, 567 bp, Homo sapiens
cagagtccaaacagtgctcagagtccaaacagtgcccagagtccaaacagtgcccagagtccaaacagtgccagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagtggcccacacaattgtttagccaggggcagtggtgatccatcttcagcacacacctgttgcagatgctgcagtggtgtgttcgggctggcttggggtaaatgcacttcttacagatggagacggtggcgatatcattcctgccctggggtgggtacccaggcggagtggtgatggcctggtagtagtggaagacaatcaggatcagattccagtggctatagaagaaatgccagcagagtcgtggcactgagtaggttcggaggatgagaggcaggacacacaggtaggcgatagctacaatggagcctgtcagcacgaa

SEQ ID NO: 321753 - DNA, 1024 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaacaacaaaccaaaacaagaaaaacaaaagaaaaaacacggagagacaatacaagggggagaaaagagtaaaacg

SEQ ID NO: 321754 - DNA, 1135 bp, Homo sapiens
aaggctaggtacgaggctgggtggtccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321755 - DNA, 1042 bp, Homo sapiens
  misc_feature (33)..(33): n is a, c, g, or t
ctagtggatcccccgggctggcaggagttcggnacgagccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321756 - DNA, 1388 bp, Homo sapiens
cccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321757 - DNA, 1219 bp, Homo sapiens
tgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactgggaaaaaaaaaaaaaaacaaaaaaaaaacaaaaaaaaacaaaagaacaacgccgcaggcggccactacatatgcgacgggctgcgcaaacaaagggccacggcaacacgggccgcccggggccacgaggcggtcaccccggacccccctctcgcgtcccacaggggggcaaccccgcgcgccccccacaaacacaggagggacacacatcaccaaaacccggctaacccgctaggaagacgcg

SEQ ID NO: 321758 - DNA, 1124 bp, Homo sapiens
gtgacagcttccggcaactgatgcctccactggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacggtactggcgccgaaagacgttcaataaatacttattgaatgacgaatacgcgttaggagtttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaagg

SEQ ID NO: 321759 - DNA, 894 bp, Homo sapiens
gtgacagcttccggcaactgatgcctccactggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacggtactggcgccgaaagacgttcaataaatacttattgaatgacgaatacgcgttaggagttggtaaaatctctcaaggcttcacctcctcagtgggctaggtgcaattctaaccagggggcaagtttccttagctttccctacgaccccagttaggcagctcaggttactattgcagcttgatggcccttgggactccaggtttttgagtggacgtggctgctactgcagcaggtgatccacaaccaagttctctatcagggtaatgttaggaattaaccttggccgggcgcggtagctcacgcctgtaatcccagcactttgggaggccaaggtgggtggatcacctgaggtcaggagttcaagaccagcctggccaacatggtgaaaccccgtctct

SEQ ID NO: 321760 - DNA, 439 bp, Homo sapiens
ttttttcctcttcccaagtacagacgcagagcagacttgtctttccgcttaacctcaacctcgtgtgatctgccagtttcgctcccgacgccaaattccagcgaaacagctgatgccagccagcttgaagacccctgccacagaagaagggaatcagcatgagaatacagcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctgcaacctggtgtcccagtgtattaacttgccatgggcatcagacaacaaacctatatatagtatcccaaatatggtgctccactttgaaa

SEQ ID NO: 321761 - DNA, 568 bp, Homo sapiens
ttttttcctcttcccaagtacagacgcagagcagacttgtctttccgcttaacctcaacctcgtgtgatctgccagtttcgctcccggttagcccaggactttttatagcatagagttttaaagcaagggcttagaatcagacctgggtcaaaatcctgccttccaccttcaccaaggcagtgtgaccttgacgttcctacataagagattaaaatacgccaaattccagcgaaacagctgatgccagccagcttgaagacccctgccacagaagaagggaatcagcatgagaatacagcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctgcaacctggtgtcccagtgtattaacttgccatgggcatcagacaacaaacctatatatagtatcccaaatatggtgctccactttgaaa

SEQ ID NO: 321762 - DNA, 3860 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321763 - DNA, 3806 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321764 - DNA, 2469 bp, Homo sapiens
gtgacagcttccggcaactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321765 - DNA, 3836 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321766 - DNA, 2878 bp, Homo sapiens
gtgacagcttccggcaactgatgcctccactggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321767 - DNA, 2538 bp, Homo sapiens
gtgacagcttccggcaactgatgcctccactggccactcctccctccgtccacctgtcacttcgggtagctgggaggccagcaaaataaggacctttaggtgttctattataagtgaagatctaagattttccaagttacaactgaagagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321768 - DNA, 2943 bp, Homo sapiens
gtgacagcttccggcaactgatgcctccactggccactcctccctccgtccacctgtcacttcgggtagctgggaggccaggtgaggggcgcgcacgggggaggggcgtgcatagttgagacagaaacccggaagacccaactgtggcgcggcactgcttgaccgaggggctccggagcccagctgcaccggctgcggtttgagcgcccagggccggggtgcggggtggaccgcggcggcccttcgaccaaaggtgcttgaagctcgagcccattactttctgtggactctgactcgagctgcaaaagcttttctgcactgtttttctcatctatgttatgaagataataattccggccctaaccgtagtatgcttgcgagaatccaacaatatgatgtttctgaaagcgccggctgaactaagagcgcgtgaaatagaatgacagacagctctgcaagaacggaggccctgtctattttgtacccagctgtacggtactggcgccgaaagacgttcaataaatacttattgaatgacgaatacgcgttaggagtttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321769 - DNA, 4905 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321770 - DNA, 2924 bp, Homo sapiens
actcggaaagggaactccctgaccccttgcgcttcccaggtgaggcaatgcctcgccctgcttcggctcgcgcacggtgcgcgctcccactggcctgcgcccactgtctggcactccctagtgagatgaacccggtacctcagatggaaatgcagaaatcacccctcttctgcgtcgctcacgctgggagctgtagaccagagctgttcctattcggccatcttggctcctccagaataaacctattttttgaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321771 - DNA, 3076 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacatta

SEQ ID NO: 321772 - DNA, 4891 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcatcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321773 - DNA, 2761 bp, Homo sapiens
actcggaaagggaactccctgaccccttgcgcttcccaggtgaggcaatgcctcgccctgcttcggctcgcgcacggtgcgcgctcccactggcctgcgcccactgtctggcactccctagtgagatgaacccggtacctcagatggaaatgcagaaatcacccctcttctgcgtcgctcacgctgggagctgtagaccagagctgttcctattcggccatcttggctcctccagaataaacctattttttgagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321774 - DNA, 2782 bp, Homo sapiens
ggcaatggcgggtgcccgtcccccagcctcgctgccgccttgcagtttgatctcagaccgctgtgctagcaatcagcgagattccgtgggcgtaggaccctccgagccaggtgaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321775 - DNA, 2925 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgagacgccaaattccagcgaaacagctgatgccagccagcttgaagacccctgccacagaagaagggaatcagcatgagaatacagcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctgcaacctggtgtcccagtgtattaacttgccatgggcatcagacaacaaacctatatatagtatcccaaatatggtgctccactttgaaa

SEQ ID NO: 321776 - DNA, 2731 bp, Homo sapiens
  misc_feature (2688)..(2688): n is a, c, g, or t
  misc_feature (2697)..(2697): n is a, c, g, or t
  misc_feature (2699)..(2699): n is a, c, g, or t
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagacggacccccccccccccccctaccccccgccccgcccccccccgccccaaagttggcaatttctttcctcanccccccccnanaactccccccccccccccctcagtagaattag

SEQ ID NO: 321777 - DNA, 2498 bp, Homo sapiens
aaaaaacaaaaaacgaataagcctttatgagaaattttctctcctaccaaataataacaataacagctttcatgtgagtatctactatgttctatgcactgtgcaaaacactttacgtgttgccttattaagttctcataacagcccatcaaatagtgtcttatttttctgatgaggcagaaggcataggtaagagagagattaaatagtctgccaaagttatatagtgatagaactaactataaaacacaaatagaaggagatccaggacataagagttgaaatacagaaagaaaataacagaagccatcaagacatcagacttctcgtcactgaggagaagaggaaaacccttaagagtttcagtctgaagtttttatttagtcattttcttttctttttaaggaaacatttattatatttaaattttgtttttaagttgctagcatctgcctgtgtaaagccattttaaggttttgccattattaaaggaaagaaggaaactctgtaaaacaatgtgtctgttctggcagcaaaataaggacctttaggtgttctattataagtgaagatctaagattttccaagttacaactgaagaggtaatctagatattaaagtatataattgcgatttataaattaaatatgtgaactttctcctagaaatatcagcaatttggaattatattgacatatttttgtctgaatcaatgagtctgtttcaaaatttcagtctcatcagaattataatgtgtattatttcccagctcaaataagaccccttcttccttcctttgaggaagtactgggcacgtaagatttttttccataagacaagttccagcaaagagaatataaagattagtaagacatactcccagccctcaaggatctcattgtccagtaaagggatttatatatacacgaatgtaatggaatctagcctttacaacaatagagctaggtacacggattcccaaatatggaaatggtgaaacgaaattcagggaagactttaggagagaaaggtcttagagaataaatgtgaactatacagtagaagaaggtagttctcattgccattttcttactgagttgtagtaccagattgagtcccaagtcatattcttactgatttttaggctgtagtatacaaaatttaaaactttaatgaacagccaagcacggtcactcatgcctgtaatcccagggctttgggaggcagaagggggaggatctcctgagcccaggagttccaggctgcagtaagccctgatcatacaactgcactccagcctgggtgaaagagctagaccttgtctccaaaaaataaaaataaaaaaatcaaagctttaatgaacatccttaattagatatggcaataatatcctttggtcattgagtaaaactctttatttttatatacttaaaagtgttctttttattttaaaacatctgtataatttttagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaagacgccaaattccagcgaaacagctgatgccagccagcttgaagacccctgccacagaagaagggaatcagcatgagaatacagcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctg

SEQ ID NO: 321778 - DNA, 2301 bp, Homo sapiens
gtgacagcttccggcaactgatgcctccactggccactcctccctccgtccacctgtcacttcgggtagctgggaggccagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattat

SEQ ID NO: 321779 - DNA, 2865 bp, Homo sapiens
ggcaatggcgggtgcccgtcccccagcctcgctgccgccttgcagtttgatctcagaccgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321780 - DNA, 3131 bp, Homo sapiens
cggtggtacgtgggaagtgtgctgcaatcatgagcataggagctgggcaccccatgtcgtgcaggtgcgcttttcatgcatggcttgaaagctgtggttgttatccctgcagagaaggtatatggcctgggggagttttgagttctgtgctcagatggcctggaacttagggtcgttgctgctagtagaaagctgtgggtgtgagatctgccttgccaagtgtgtgggagctgggtgggacttaccactgcctgctactccacatttcctgcagtacttttctgttcaacagaggcagctatgctcctctttggaacattaccccagggtccagagaactgtctcctgactcccacaggggctgctgcttgctctgcacatggagagtcagaccaaagacctgcctaactcagcccccacctggctttgcccctctacctgcctggtatcttaacacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaagaaaaatgtctagatttacacattgtcaatacagtatattagttctgcaaatgcacttttgttaaactcaaacatgctctttgtcaagacttggctaaccagtgagcttgtagctctgattatctagcatttttagggtcattctccttaataggcttttatgttaataagatatatttttagaagagcttgtttgggagattagagaataagataaaagaaccaaaaccttaggatatactgtttctgggtctgaaatctctctcattgtttacttctgttcactcagtgaaaacagaaacaagaatgaggtagtggcaatgaaatagaattattagtatattatgaacattataacattttgaacactataatgcattatatattatgaacttttatgaactttatacatgagtaatagcttcctaaagtttataaaacattgtttaggttacataaagattaccaagtaagactcaaaattgcaaatataaacaaaagaaaaatccaactgaaaataacactaagtatttttgagttcctagaatgtccattttggtatttggttacattatcatatttactagtcactatcagcacaattaggttaataaagaagtgggtcattatattcaaagagtgctcaggaagttatgtgttcaaagttctctcataaataccatcgtctgcctgatactgctcttgtctaatagagggttgacattacaaaagaaaagatgtctgactcaagaactcagttgattctgtttgccttaagtttggttcagtgataggctgtcttctaacccctatactcctcttctctcctttaatagatgaggaaactaagggcaaacagttcgttacacttacgggaatcttatttccctctctaggggcagcatgttttcaccttctcctttgctgccaccttggcctaaactagcaccgtcttttagctagaccattgcgttaactgttctcctacacccatttttgttctttatttccacccacatgagtcactgcagccaatctattacaaatttaaatctgattatgaattcccctcctaaaactcttttttaaaagagactttattttttggagcagttttaggttcacagcaaaattgaacagaaagtacagagttccaatacagcccctatcagcatacatgcatagcctcccccactatcaacatcccagcaccagaatggtacatttgttagaatcaatggccctacattgacacattatcacccaaaggccatggttcaagttagagatcactcttgatgtagtacatcctatgggctttgataattataaaatgacatgtatccaccattatagtattatacagagtagtttcactgccctaaaaatcttctgtgttctgcctatttatcccaccctccctccaacccctggcaaccactgatctttttactgtctccatagttttgccttttccatatgtcatatcattggaatcatacagtatgtgacctcttaagattgtcttctttaacttacttagtaatatccatttaaggttcctgcatgtcttttcatgacttgatagctcatttcttttagtgctaagtaatattcgattgtctgaatatactactactgaaggacatcttggttgcttccaagttttgaaaat

SEQ ID NO: 321781 - DNA, 2294 bp, Homo sapiens
ccgcccgccctcgctccctccactcctctcccctcccctccccggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaaga

SEQ ID NO: 321782 - DNA, 2242 bp, Homo sapiens
acaaatatgtcagtaggccggcaccgtgtggttaattcagccaccggcctgcgctgtcgttgacagtgccttgggctggccgatcgtcctgacctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaaga

SEQ ID NO: 321783 - DNA, 1870 bp, Homo sapiens
ccgcccgccctcgctccctccactcctctcccctcccctccccggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaaga

SEQ ID NO: 321784 - DNA, 415 bp, Homo sapiens
agcaggcaggagaaggatggagaaacaagtcagtgtggaagatgagacagacattaatgccgagagagaggaaaagcggggagaggcagagggcgagagagacagaaggcaggggacacaccacggagacagtgccgacgtctggaagcgagagagctggagagacgaaggggccggcggtgtggagacacacaagagagcgtgctgggcagctccgtgtctcacagagacatgatagaggcagccatggggagggaaaacgggggcccaggtgggcaggccccagtggtgcttgctcagcccagccttgtgcccacagcctacaaggagaagatgaaggagctgtcggtgctgtcgctcatctgctcctgcttctacacacagccgcaccccaataccgtctaccagtacgggg

SEQ ID NO: 321785 - DNA, 2839 bp, Homo sapiens
ccgcccgccctcgctccctccactcctctcccctcccctccccggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagaaaaaaaaaaaaaaaaaaaaaacaaaaaaaaaaaaagggggggggggcaaaaattctccccgggggggcccaatttgggcggttcaccgagattttttgtggtgtaacgagagggggggccccatatatagggggggaagccgtattattaaaaagagcctaaggacaggggagacggtggtttttaaacaaaggttccgtggacgggggaaatgagctggctcagctcggggagcaatcttgggggggaaaggggaaacacctctaatttatgcgggggggggggagagccacatctgttgggggcgcaaataattcaccctctacagaggaaagatttttataagcgcgcctccataaggggggcaaatattctttacaacttttcaacaacgcggtcgatacatacgtcggggtgtgttaaaaccaccacgcgcgcgagatatattggcgtagcggcgtgtataagaaaaaggttttcgggcctcacaacggggcggactttatcgttttttctcggaagcacattttttttttccgcagggt

SEQ ID NO: 321786 - DNA, 2126 bp, Homo sapiens
cggagctcggaggggcgcagagcggggccggggactccgaggcgctgagctggggtgggggtcgggggctcctcccgtgtttactgggcgtccccagcagcgcacgaggcaggtccagagtctggtcctggcgggacagtaactagccgcagtaatagatggctaaattcattatattgaaagtgccctgaaggaagctcggctccggtacgagctagaagcggggcccagccagctcccaggaaacccgtccttggtccctggccttgctctgcgcctccccggtgctcccgccccctcaactcagtcagggtcctgccgaaggccagcccggatgaggccgggcgggtgccagggcgccacggcctgcgcgcctgggggttcccggagtcgccccaagccacccccgccctcaggccctcccgccccctgtcctgcaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaaga

SEQ ID NO: 321787 - DNA, 1613 bp, Homo sapiens
tccgcagccaggcgcttgctcctctctctcttcctccctcccttcctccctccctccttcccccgcccccgcagtctctctctctctctctccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaaga

SEQ ID NO: 321788 - DNA, 269 bp, Homo sapiens
tagtacctgattgtggttttgatttgcattctctaaagacttatgtttagcatcttttcatatgcttgttggccatttccgtaccttctttagagaaatgtctactcaaggcctttacccatttttgaaatgggtggtttgtccttttgtggctgggttgtaggagctcctggcatgttctgagtaccaggctcttgtgagagatgtgatgtgcagatgtcttctcttgttctatgggttgtcgttatttacattcctcataattaatg

SEQ ID NO: 321789 - DNA, 195 bp, Homo sapiens
cccaaaacatgaacatcccctacaaggtaggcagtggtccactgcatttccctctaccttcttatgattcaagaactaatacgatgtgggaaccaagattgtctcttttgggtgaatggctccttgattcccatgcatctccctgattttgttgtgtatgagttatatactggacatgtccatctgaggtcaccg

SEQ ID NO: 321790 - DNA, 1061 bp, Homo sapiens
agcggaggacgcctgcgcgttgtgtcgccgacgttgtgtagtctcccctgggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321791 - DNA, 910 bp, Homo sapiens
cggaagtggccggctgggatcagcctttaagatggcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321792 - DNA, 1953 bp, Homo sapiens
gctgcgcctactactaccagacacggcccgccggctgccgctactacttcgtggatgccaccaccatcacagagtgtcttcatacttgtgagtgccttggagactgcctagttcttccagtccctagtcttcaccaagctgactgccagcttctgtgcggcctgcctcacgcatccaggcaccccacccagcccatgaatccagtttccagagggcctgagaatctgcttttcttttcctgcagtctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgagtcaccaacctgactttgagaggcctcttgaggactaattgctgagtggcagcttgaggtgacgggtttggtaggactcacgtaggcagaaggccaaagatgagggaaggacaaaaagtgaggaagggctaatactttattcttttttttctttttttgagacggagtcttgcccaggctggagtgcagtggcgcaatctcagctcactggaagctccacctcctggattcatgccattctcctgcctcagcctcctgagtagctgggactacaggcgcccaccaccatgcccagctaattttttatattttttagtagagacggggtttcaccatgttagccaggatggcctcaatctcctgacttcatgatctgcccacctctgcctcccaaagtgctgggattacaggcgtgagccaccgcgcccggccccgaagggctaatactttattctcatacttcaccttcttctaggtgaagagaaacggattcgggaattctaccagtcccgaggtttggaccgggtcacccagcccactggggaaggtatgtccttggccgcgggacagtaaagaccccagagcattcttcttgcccagttttgctctctggggaaagaggagtatggaatgtgtgccaccagccacctcactaccctatctttctcagagccagcactgagcaacctcggcctccccttcagcagctttgaccactctaaagcccactactatcgctatgatgagcagttgaacctgtgcctggagcggctgaggtgaggagaaggtcaggggttgcaggaggtgacagtgccaatgacccagagccagggagggtctaggggagaggctgagcagtgagtgagtgcctatccccttgaagagagtatatcatggctctgggtggggaagaggaggaaagataggattccctaacctgtgtctatttccccccagttctggcaaagacaagaataaaagcgtcctgcaggtgagaagggctgaggggagggcctctctaaggagactcacctcccatggtccttccctcacacaccttgccctcttccctcccctccctgctcccagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaaggtaagccaggccaccctccctgggatcacacccccttcagactccccccaaccatcctacagtcctcaggggaagggtgggctgaggggccctttgaataatataagaacattccccactgactactacttcctcattctctccttagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321793 - DNA, 2090 bp, Homo sapiens
agcggaggacgcctgcgcgttgtgtcgccgacgttgtgtagtctcccctgggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgagtcaccaacctgactttgagaggcctcttgaggactaattgctgagtggcagcttgaggtgacgggtttggtaggactcacgtaggcagaaggccaaagatgagggaaggacaaaaagtgaggaagggctaatactttattcttttttttctttttttgagacggagtcttgcccaggctggagtgcagtggcgcaatctcagctcactggaagctccacctcctggattcatgccattctcctgcctcagcctcctgagtagctgggactacaggcgcccaccaccatgcccagctaattttttatattttttagtagagacggggtttcaccatgttagccaggatggcctcaatctcctgacttcatgatctgcccacctctgcctcccaaagtgctgggattacaggcgtgagccaccgcgcccggccccgaagggctaatactttattctcatacttcaccttcttctaggtgaagagaaacggattcgggaattctaccagtcccgaggtttggaccgggtcacccagcccactggggaaggtatgtccttggccgcgggacagtaaagaccccagagcattcttcttgcccagttttgctctctggggaaagaggagtatggaatgtgtgccaccagccacctcactaccctatctttctcagagccagcactgagcaacctcggcctccccttcagcagctttgaccactctaaagcccactactatcgctatgatgagcagttgaacctgtgcctggagcggctgaggtgaggagaaggtcaggggttgcaggaggtgacagtgccaatgacccagagccagggagggtctaggggagaggctgagcagtgagtgagtgcctatccccttgaagagagtatatcatggctctgggtggggaagaggaggaaagataggattccctaacctgtgtctatttccccccagttctggcaaagacaagaataaaagcgtcctgcaggtgagaagggctgaggggagggcctctctaaggagactcacctcccatggtccttccctcacacaccttgccctcttccctcccctccctgctcccagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaaggtaagccaggccaccctccctgggatcacacccccttcagactccccccaaccatcctacagtcctcaggggaagggtgggctgaggggccctttgaataatataagaacattccccactgactactacttcctcattctctccttagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321794 - DNA, 1218 bp, Homo sapiens
agcggaggacgcctgcgcgttgtgtcgccgacgttgtgtagtctcccctgggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcaggaggaggttcgagtgaagatcaaagacttgaatgaacacattgtttgctgcctatgcgccggctacttcgtggatgccaccaccatcacagagtgtcttcatacttgtgagtgccttggagactgcctagttcttccagtccctagtcttcaccaagctgactgccagcttctgtgcggcctgcctcacgcatccaggcaccccacccagcccatgaatccagtttccagagggcctgagaatctgcttttcttttcctgcagtctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321795 - DNA, 852 bp, Homo sapiens
cggaagtggccggctgggatcagcctttaagatggcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatccctgggttaatcaggggtaaggggggaacacacacaagaccgctccctttgtcccacccatggagactacagccctacccgggg

SEQ ID NO: 321796 - DNA, 851 bp, Homo sapiens
agcggaggacgcctgcgcgttgtgtcgccgacgttgtgtagtctcccctgggaaaggagggtcaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321797 - DNA, 974 bp, Homo sapiens
agcggaggacgcctgcgcgttgtgtcgccgacgttgtgtagtctcccctgggaaaggagggtcaggcgagtccacgtgagggaagcccccgctgtgcgcggagccctctgctgggcggagggggagtgccagcccccaggagctaatccccggctgatggcgcagggcgcggggcttggccgtctagtgtgatgaaggaggcgacccccaaggtgggaaggcgcacgggttggggtttgagggtggatgattggtgacggagggtgtatcttcaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatggtgcaagctccttttttgacaactgaaagttctcccttgaatcacatgaccaatgaaagcaggatatggggtcctcccggctgggttcgggcagagccattcccctttgctttttacaatccaggtgtgcaaacgaacag

SEQ ID NO: 321798 - DNA, 825 bp, Homo sapiens
agcggaggacgcctgcgcgttgtgtcgccgacgttgtgtagtctcccctgggaaaggagggtcaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtagggccaagcccccaccccatcccactccccttccctccccagatatttatgtgaaatgaactgcagctttattttttgaaataaaaacttttaaaaagca

SEQ ID NO: 321799 - DNA, 2638 bp, Homo sapiens
ggcagtgggcgtggcggtgctgcccaggtgagccaccgctgcttctgcccagacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagcgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatctttggtttccttttttcccataagacaatgacatacgcttttaatgaaaaggaatcacgttagaggaaaaatatttattcattatttggtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaccaccttaatatgctgcaacaaaatgtagaatattcagacaaaatggatacataaagactaagtagcccataaggggtcaaattttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccatgttgcaggttcatggattacttctctataaaaaatatgtatttaccaaaaaattttgtgacattccttctcccatctcttccttgacatgcattgtaaataggttcttcttgttctgagattcaatattgaatttctcctatgctattgacaataaaatattattgaactaca

SEQ ID NO: 321800 - DNA, 512 bp, Homo sapiens
ctgaagtgggaggggccgcatctttcatttttgatagctgtcccatctggtcatttggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccatgttgcaggttcatggattacttctctataaaaaatatgtatttaccaaaaaattttgtgacattccttctcccatctcttccttgacatgcattgtaaataggttcttcttgttctgagattcaatattgaatttctcctatgctattgacaataaaatattattgaactaca

SEQ ID NO: 321801 - DNA, 525 bp, Homo sapiens
ggcagtgggcgtggcggtgctgcccaggtgagccaccgctgcttctgcccagacacggtcgcctccacatccaggtctttgtgctcctcgcttgcctgttccttttccacgcattttccaggataactgtgactccaggtaagcaaggtggggtagcagggctggtgacttccttttttcagggaaattcataaatatcgttatttgagctgatttgagatggtgaacaaaatggacttaggtccattttggggctgttttcaaagacgggctgttgggttgagtactgtcgcctctcatcccccatgttggcagtatttccagctcccaaccctttgagcaccaggaacactgcagagggagtaaaatcacttaaccatacaaggtaagaatatgaagaagtcacgtggctcggaggttttggtggtagaggggtgcaaccgtgattcacggaggagaaaatacttctgaggacattttcaggcctactttggaactcagaatgaattttgcaatgctagtttc

SEQ ID NO: 321802 - DNA, 2906 bp, Homo sapiens
gctaaagcacccagagggactagacagactctggctagaggcacttgtcctgaaatctgattcctgcctgatgatggtgtctcttgtatcaatctctctctctggtctttgaattggatagaaattataacccagcttcatcgttctccaagtttggaaatccttctgtgtgagtattaagggcatcactttgaagaaaggacaaatgttctcgatggttgatttggaagagtacctttatggtagtgtttctcagtggggacaatttgtcctccccttcccactctgggataatctggcaatgtctggagacattctgggttctcacaaataggaggaggatgccactggcatctagtaggtcagcgatgctgctaagcatcctgcagtgcccaggacagccccacaaagactcatccagcctgaatgtcaatagtgctgaggtcgaggagccttactttacgggaactaggcaggaggagtctgtatgcccaaggacgttggtcattatcacgtgtccacttcagtacagcactactcagaggcaatgctttttgggtaacggatttttctcttaacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagcgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatctttggtttccttttttcccataagacaatgacatacgcttttaatgaaaaggaatcacgttagaggaaaaatatttattcattatttggtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaccaccttaatatgctgcaacaaaatgtagaatattcagacaaaatggatacataaagactaagtagcccataaggggtcaaattttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccatgttgcaggttcatggattacttctctataaaaaatatgtatttaccaaaaaattttgtgacattccttctcccatctcttccttgacatgcattgtaaataggttcttcttgttctgagattcaatattgaatttctcctatgctattgacaataaaatattattgaactaca

SEQ ID NO: 321803 - DNA, 795 bp, Homo sapiens
  misc_feature (769)..(769): n is a, c, g, or t
ggcagtgggcgtggcggtgctgcccaggtgagccaccgctgcttctgcccagacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaaatgaaaggactgtcaattatcttcaacatcgcttctttggcttgtcttgcctactcgatgattgagaagggtatgccgagaaacgatgaatggggggaaccnagttatgtataccgggatcctctaaa

SEQ ID NO: 321804 - DNA, 2983 bp, Homo sapiens
acacaattcaacccattacacttactaaatattaaactgaacaatgcaaaactgctgcaattcgactgtttttgttttataaaagttttaactttgtagtttaactgaaatcctaatggaaacaatatgtgataaataaaaccaactgatgttgattagtgctgtcaacttttctgacatatgctggagaagagatgtgaccactgggctcccgacaatggccactgtggctgagcaggcccaagactgcagagtctaggcagagctggacacacagaggacctcacatgccttcagacatttgcctggaagtttcttcacaactgatcttacttttgaatttacagaaagttccttgtttcttctgagatcaattactttgtttaaatagaattcttatagtgttggcagaatgcagttgagaagacgttaaagatgctttagaaactaactgctcccttgtccttgcttccaggcccgcaagcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagcgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatctttggtttccttttttcccataagacaatgacatacgcttttaatgaaaaggaatcacgttagaggaaaaatatttattcattatttggtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaccaccttaatatgctgcaacaaaatgtagaatattcagacaaaatggatacataaagactaagtagcccataaggggtcaaattttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccatgttgcaggttcatggattacttctctataaaaaatatgtatttaccaaaaaattttgtgacattccttctcccatctcttccttgacatgcattgtaaataggttcttcttgttctgagattcaatattgaatttctcctatgctattgacaataaaatattattgaactaca
